United States Patent 12,569,549 (FLAVIVIRUS VACCINE) - sequence listing, part 50

SEQ ID NO: 18040 - RNA, 9873 nt, synthetic construct
  misc_feature 1..9873: note = derived and/or modified CDS sequence (opt4) from DENV-3__EU596492__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctgaacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatgccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18041 - RNA, 9873 nt, synthetic construct
  misc_feature 1..9873: note = derived and/or modified CDS sequence (opt4) from DENV-3__EU596493__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18042 - RNA, 9873 nt, synthetic construct
  misc_feature 1..9873: note = derived and/or modified CDS sequence (opt4) from DENV-3__EU596494__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcagcaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccagaagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18043 - RNA, 9873 nt, synthetic construct
  misc_feature 1..9873: note = derived and/or modified CDS sequence (opt4) from DENV-3__EU687218__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagaagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18044 - RNA, 9873 nt, synthetic construct
  misc_feature 1..9873: note = derived and/or modified CDS sequence (opt4) from DENV-3__EU726772__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaagggcagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18045 - RNA, 9873 nt, synthetic construct
  misc_feature 1..9873: note = derived and/or modified CDS sequence (opt4) from DENV-3__FJ182013__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacgtgggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18046 - RNA, 9873 nt, synthetic construct
  misc_feature 1..9873: note = derived and/or modified CDS sequence (opt4) from DENV-3__EU781136__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18047 - RNA, 9873 nt, synthetic construct
  misc_feature 1..9873: note = derived and/or modified CDS sequence (opt4) from DENV-3__EU781137__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctggtgatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18048 - RNA, 9873 nt, synthetic construct
  misc_feature 1..9873: note = derived and/or modified CDS sequence (opt4) from DENV-3__EU726773__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18049 - RNA, 9873 nt, synthetic construct
  misc_feature 1..9873: note = derived and/or modified CDS sequence (opt4) from DENV-3__EU726774__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatggtgggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18050 - RNA, 9873 nt, synthetic construct
  misc_feature 1..9873: note = derived and/or modified CDS sequence (opt4) from DENV-3__EU687219__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgtgagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtgatcaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18051 - RNA, 9873 nt, synthetic construct
  misc_feature 1..9873: note = derived and/or modified CDS sequence (opt4) from DENV-3__EU726768__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18052 - RNA, 9873 nt, synthetic construct
  misc_feature 1..9873: note = derived and/or modified CDS sequence (opt4) from DENV-3__EU687226__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccgtgagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcacaagcagacccagagaagcggcgtgccctgggacgtgcccagcccccccgagacccagaaggccgagctggaggagggcgtgtacagaatcaagcagcagggcatcttcggcaagacccaggtgggcgtgggcgtgcagaaggagggcgtgttccacagcatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18053 - RNA, 9876 nt, synthetic construct
  misc_feature 1..9876: note = derived and/or modified CDS sequence (opt4) from DENV-3__EU687233__SS-prME
  source 1..9876: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacacctgccacagcaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18054 - RNA, 9873 nt, synthetic construct
  misc_feature 1..9873: note = derived and/or modified CDS sequence (opt4) from DENV-3__EU687234__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18055 - RNA, 9873 nt, synthetic construct
  misc_feature 1..9873: note = derived and/or modified CDS sequence (opt4) from DENV-3__EU687196__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgatcttcaccttcgtgctgctgctgagcggccagatcacctggagagacgtggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacatgagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccgtgagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacatcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcttcagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18056 - RNA, 9873 nt, synthetic construct
  misc_feature 1..9873: note = derived and/or modified CDS sequence (opt4) from DENV-3__EU854298__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagaggtgcacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctggcctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatccccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccaccaggtgagaagcctgatcggcaacgaggagttcctggactacatgcccagcatgaagagattcagaaaggaggaggagctggagggcgccatctggtga

SEQ ID NO: 18057 - RNA, 9873 nt, synthetic construct
  misc_feature 1..9873: note = derived and/or modified CDS sequence (opt4) from DENV-3__FJ373306__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacgtgggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcagcaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18058 - RNA, 9873 nt, synthetic construct
  misc_feature 1..9873: note = derived and/or modified CDS sequence (opt4) from DENV-3__EU687197__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctggcctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcagaaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccaccaggtgagaagcctgatcggcaacgaggagttcctggactacatgcccagcatgaagagattcagaaaggaggaggagctggagggcgccatctggtga

SEQ ID NO: 18059 - RNA, 9873 nt, synthetic construct
  misc_feature 1..9873: note = derived and/or modified CDS sequence (opt4) from DENV-3__EU687198__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcgtgggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18060 - RNA, 9873 nt, synthetic construct
  misc_feature 1..9873: note = derived and/or modified CDS sequence (opt4) from DENV-3__EU726769__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatggtggccggcgtgttcttcaccttcgtgctgctgctgagcggccagatcacctggagagacatggcccacaccctgatcatggtgggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatcgccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaaggtgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18061 - RNA, 9873 nt, synthetic construct
  misc_feature 1..9873: note = derived and/or modified CDS sequence (opt4) from DENV-3__EU687239__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcgtgggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccgtggccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgtgatctggtga

SEQ ID NO: 18062 - RNA, 9873 nt, synthetic construct
  misc_feature 1..9873: note = derived and/or modified CDS sequence (opt4) from DENV-3__FJ182004__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18063 - RNA, 9873 nt, synthetic construct
  misc_feature 1..9873: note = derived and/or modified CDS sequence (opt4) from DENV-3__FJ024465__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctggccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacagccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18064 - RNA, 9873 nt, synthetic construct
  misc_feature 1..9873: note = derived and/or modified CDS sequence (opt4) from DENV-3__FJ024466__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacagattccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgacaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccaccagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18065 - RNA, 9873 nt, synthetic construct
  misc_feature 1..9873: note = derived and/or modified CDS sequence (opt4) from DENV-3__FJ024467__SS-prME
  source 1..9873: mol_type = other RNA
accagcctgtgcctgatgatggtgctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccagacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggagatgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccgccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagccatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgagaacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18066 - RNA, 9873 nt, synthetic construct
  misc_feature 1..9873: note = derived and/or modified CDS sequence (opt4) from DENV-3__FJ024468__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18067 - RNA, 9873 nt, synthetic construct
  misc_feature 1..9873: note = derived and/or modified CDS sequence (opt4) from DENV-3__FJ024470__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagagccaccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18068 - RNA, 9873 nt, synthetic construct
  misc_feature 1..9873: note = derived and/or modified CDS sequence (opt4) from DENV-3__FJ024471__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcaacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagagccaccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18069 - RNA, 9873 nt, synthetic construct
  misc_feature 1..9873: note = derived and/or modified CDS sequence (opt4) from DENV-3__FJ182005__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcatcctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaaggcctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18070 - RNA, 9873 nt, synthetic construct
  misc_feature 1..9873: note = derived and/or modified CDS sequence (opt4) from DENV-3__FJ373302__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggcctacacccagctgtgcgaccacagactgatgagcgccgccgtgaaggacgagagagccgtgcacgccgacatgggctactggatcgagagccagaagaagggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagcaagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18071 - RNA, 9873 nt, synthetic construct
  misc_feature 1..9873: note = derived and/or modified CDS sequence (opt4) from DENV-3__FJ182007__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgaggactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatcgccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18072 - RNA, 9873 nt, synthetic construct
  misc_feature 1..9873: note = derived and/or modified CDS sequence (opt4) from DENV-3__FJ182008__SS-prME
  source 1..9873: mol_type = other RNA
accagcctgtgcatcatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcatcagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18073 - RNA, 9873 nt, synthetic construct
  misc_feature 1..9873: note = derived and/or modified CDS sequence (opt4) from DENV-3__FJ182010__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcaggtggccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccgacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18074 - RNA, 9873 nt, synthetic construct
  misc_feature 1..9873: note = derived and/or modified CDS sequence (opt4) from DENV-3__FJ182011__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgacaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccaccagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18075 - RNA, 9873 nt, synthetic construct
  misc_feature 1..9873: note = derived and/or modified CDS sequence (opt4) from DENV-3__FJ182038__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccaccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacaagatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18076 - RNA, 9873 nt, synthetic construct
  misc_feature 1..9873: note = derived and/or modified CDS sequence (opt4) from DENV-3__FJ182041__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcacccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18077 - RNA, 9873 nt, synthetic construct
  misc_feature 1..9873: note = derived and/or modified CDS sequence (opt4) from DENV-3__FJ390371__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgaccaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18078 - RNA, 9873 nt, synthetic construct
  misc_feature 1..9873: note = derived and/or modified CDS sequence (opt4) from DENV-3__FJ390372__SS-prME
  source 1..9873: mol_type = other RNA
accagcctgtgcctgatgatggtgctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcgtgatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccaccagagagtgttcaaggagaaggtggacaccagaacccccagaagcatgcccggccccagaagagccatgggcatcaccgccgagtggctgtggagaaccctgggcagaaacaagaagcccagactgtgcaccagagaggagttcaccaagaagggcagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgccaccgccggctgggacaccagaatcaccgaggacgacctgcacaacgaggagaagatcacccagcagatggaccccgaccacagacagctggccaccgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18079 - RNA, 9873 nt, synthetic construct
  misc_feature 1..9873: note = derived and/or modified CDS sequence (opt4) from DENV-3__FJ205870__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcatcctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcccaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18080 - RNA, 9873 nt, synthetic construct
  misc_feature 1..9873: note = derived and/or modified CDS sequence (opt4) from DENV-3__FJ390373__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggcagaggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgccctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18081 - RNA, 9873 nt, synthetic construct
  misc_feature 1..9873: note = derived and/or modified CDS sequence (opt4) from DENV-3__FJ205871__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggcctacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18082 - RNA, 9873 nt, synthetic construct
  misc_feature 1..9873: note = derived and/or modified CDS sequence (opt4) from DENV-3__FJ390375__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18083 - RNA, 9873 nt, synthetic construct
  misc_feature 1..9873: note = derived and/or modified CDS sequence (opt4) from DENV-3__FJ390376__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagagagaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcatctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18084 - RNA, 9873 nt, synthetic construct
  misc_feature 1..9873: note = derived and/or modified CDS sequence (opt4) from DENV-3__FJ390377__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18085 - RNA, 9873 nt, synthetic construct
  misc_feature 1..9873: note = derived and/or modified CDS sequence (opt4) from DENV-3__FJ547069__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacctgggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18086 - RNA, 9873 nt, synthetic construct
  misc_feature 1..9873: note = derived and/or modified CDS sequence (opt4) from DENV-3__FJ562107__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18087 - RNA, 9873 nt, synthetic construct
  misc_feature 1..9873: note = derived and/or modified CDS sequence (opt4) from DENV-3__FJ547071__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaagaccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctgatcctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18088 - RNA, 9873 nt, synthetic construct
  misc_feature 1..9873: note = derived and/or modified CDS sequence (opt4) from DENV-3__FJ410176__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggcagcagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18089 - RNA, 9873 nt, synthetic construct
  misc_feature 1..9873: note = derived and/or modified CDS sequence (opt4) from DENV-3__FJ410177__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccggcggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18090 - RNA, 9873 nt, synthetic construct
  misc_feature 1..9873: note = derived and/or modified CDS sequence (opt4) from DENV-3__FJ547072__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcagaagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18091 - RNA, 9873 nt, synthetic construct
  misc_feature 1..9873: note = derived and/or modified CDS sequence (opt4) from DENV-3__FJ547073__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagatacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18092 - RNA, 9873 nt, synthetic construct
  misc_feature 1..9873: note = derived and/or modified CDS sequence (opt4) from DENV-3__FJ547074__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacctacagaagacccaccatcgagaaggacgtggtgctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18093 - RNA, 9873 nt, synthetic construct
  misc_feature 1..9873: note = derived and/or modified CDS sequence (opt4) from DENV-3__FJ547075__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagagcgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18094 - RNA, 9873 nt, synthetic construct
  misc_feature 1..9873: note = derived and/or modified CDS sequence (opt4) from DENV-3__FJ547076__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccgtgagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18095 - RNA, 9873 nt, synthetic construct
  misc_feature 1..9873: note = derived and/or modified CDS sequence (opt4) from DENV-3__FJ547077__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggaacctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18096 - RNA, 9873 nt, synthetic construct
  misc_feature 1..9873: note = derived and/or modified CDS sequence (opt4) from DENV-3__FJ547078__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctggatcgacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccaagagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18097 - RNA, 9873 nt, synthetic construct
  misc_feature 1..9873: note = derived and/or modified CDS sequence (opt4) from DENV-3__FJ547079__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcacaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18098 - RNA, 9873 nt, synthetic construct
  misc_feature 1..9873: note = derived and/or modified CDS sequence (opt4) from DENV-3__FJ547080__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaaccccagaaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18099 - RNA, 9873 nt, synthetic construct
  misc_feature 1..9873: note = derived and/or modified CDS sequence (opt4) from DENV-3__FJ547081__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcagcggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacgccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacagcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18100 - RNA, 9873 nt, synthetic construct
  misc_feature 1..9873: note = derived and/or modified CDS sequence (opt4) from DENV-3__FJ547082__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagatgtggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18101 - RNA, 9873 nt, synthetic construct
  misc_feature 1..9873: note = derived and/or modified CDS sequence (opt4) from DENV-3__FJ547083__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagagctacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcagcgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18102 - RNA, 9873 nt, synthetic construct
  misc_feature 1..9873: note = derived and/or modified CDS sequence (opt4) from DENV-3__FJ547084__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagagaggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgaccacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18103 - RNA, 9873 nt, synthetic construct
  misc_feature 1..9873: note = derived and/or modified CDS sequence (opt4) from DENV-3__FJ478456__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcatcctgcccgtgtgccagagcagcagcatgagaaagagcgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagaccagaagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18104 - RNA, 9873 nt, synthetic construct
  misc_feature 1..9873: note = derived and/or modified CDS sequence (opt4) from DENV-3__FJ547085__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcaccgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18105 - RNA, 9873 nt, synthetic construct
  misc_feature 1..9873: note = derived and/or modified CDS sequence (opt4) from DENV-3__EU482595__SS-prME
  source 1..9873: mol_type = other RNA
accagcctgtgcctgatgatgatgctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacgtgggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaaggtgcccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaatcctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcagcaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccgcccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggatcctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18106 - RNA, 9873 nt, synthetic construct
  misc_feature 1..9873: note = derived and/or modified CDS sequence (opt4) from DENV-3__EU482596__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18107 - RNA, 9873 nt, synthetic construct
  misc_feature 1..9873: note = derived and/or modified CDS sequence (opt4) from DENV-3__JQ922554__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgagctggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccagccaggccagcaccgccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccaagacccccacctggaacagaaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacagaaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatggccttcagctgcatcgccatcggcatcatcaccctgtacgtgggcgtggtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcgtgctggagcagggcgagagaaccctgaccccccagcccatggagctgaagtacagctggaagacctggggcaaggccaagatcgtgaccgccgagacccagaacagcagcttcatcatcgacggccccagcacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcagcgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggccagcgccggcagcggcaaggtggacaacttcaccatgggcgtgctgtgcctggccatcctgttcgaggaggtgatgagaggcaagttcagaaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccgccaccctgagactgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtgggccaagggcggcgagacccaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagctggacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagaggcagcaactacaacctgatcatcatggacgaggcccacttcaccgaccccgccagcatcgccgccatcggctacatcagcaccagagtgggcatgggcgaggccgccgccatcttcatgaccgccaccccccccggcaccgtggacgccttcccccagagcatcccccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatctacctgagaagatgcctgaagcccgtgatcctgaccaacggccccgagagagtgatcctggccggccccatgcccgtgaccgtggccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaactggagacccagatggctggacgccagaacctacagcgaccccctggccctgaaggagttcaaggacttcgccgccggcagaaagagcatcgccctggacctggtgaccgagatcggcagagtgcccagccacctggcccacaccgtgagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccacccccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctggccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctggcccctgtgcgaggtgctggccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgttccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctgggtgaagaacaaccagttctgcatcaaggtgctgaacccctacatgcccagcgtgatcgagcacctggagaacctgcagagaaagcacggcggcatcctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaaggacagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggccagagagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccaccccctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgctgggcaaggccagaatcagccagggcgccggctggagcctgagagagaccgcctgcctgggcaaggcctacgcccagatgtggaccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18108 - RNA, 9873 nt, synthetic construct
  misc_feature 1..9873: note = derived and/or modified CDS sequence (opt4) from DENV-3__EU529683__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18109 - RNA, 9873 nt, synthetic construct
  misc_feature 1..9873: note = derived and/or modified CDS sequence (opt4) from DENV-3__EU529684__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagaagctggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaccgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggacgagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18110 - RNA, 9873 nt, synthetic construct
  misc_feature 1..9873: note = derived and/or modified CDS sequence (opt4) from DENV-3__FJ182015__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18111 - RNA, 9873 nt, synthetic construct
  misc_feature 1..9873: note = derived and/or modified CDS sequence (opt4) from DENV-3__EU569688__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggccgagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagagatgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18112 - RNA, 9873 nt, synthetic construct
  misc_feature 1..9873: note = derived and/or modified CDS sequence (opt4) from DENV-3__EU529686__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgagaacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacagccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18113 - RNA, 9873 nt, synthetic construct
  misc_feature 1..9873: note = derived and/or modified CDS sequence (opt4) from DENV-3__EU529687__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18114 - RNA, 9873 nt, synthetic construct
  misc_feature 1..9873: note = derived and/or modified CDS sequence (opt4) from DENV-3__KF955449__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcgtgctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18115 - RNA, 9873 nt, synthetic construct
  misc_feature 1..9873: note = derived and/or modified CDS sequence (opt4) from DENV-3__FJ373303__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacgtgaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacgtggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18116 - RNA, 9873 nt, synthetic construct
  misc_feature 1..9873: note = derived and/or modified CDS sequence (opt4) from DENV-3__KF955451__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcgtgggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgtggtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacgtggagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaagcgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagagaaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgagcgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18117 - RNA, 9873 nt, synthetic construct
  misc_feature 1..9873: note = derived and/or modified CDS sequence (opt4) from DENV-3__KF955453__SS-prME
  source 1..9873: mol_type = other RNA
accagcctgtgcctgatgatgatcctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccaccctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcagcctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18118 - RNA, 9873 nt, synthetic construct
  misc_feature 1..9873: note = derived and/or modified CDS sequence (opt4) from DENV-3__FJ373304__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaaggtggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcatcctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18119 - RNA, 9873 nt, synthetic construct
  misc_feature 1..9873: note = derived and/or modified CDS sequence (opt4) from DENV-3__EU854291__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccgtgagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggcagcgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18120 - RNA, 9873 nt, synthetic construct
  misc_feature 1..9873: note = derived and/or modified CDS sequence (opt4) from DENV-3__KF955454__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagggcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcctggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagagccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacccccccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18121 - RNA, 9873 nt, synthetic construct
  misc_feature 1..9873: note = derived and/or modified CDS sequence (opt4) from DENV-3__EU854292__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcatcggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccgccagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttctgcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccacaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18122 - RNA, 9873 nt, synthetic construct
  misc_feature 1..9873: note = derived and/or modified CDS sequence (opt4) from DENV-3__FJ639746__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18123 - RNA, 9873 nt, synthetic construct
  misc_feature 1..9873: note = derived and/or modified CDS sequence (opt4) from DENV-3__FJ639750__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18124 - RNA, 9873 nt, synthetic construct
  misc_feature 1..9873: note = derived and/or modified CDS sequence (opt4) from DENV-3__FJ639754__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcaactacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18125 - RNA, 9873 nt, synthetic construct
  misc_feature 1..9873: note = derived and/or modified CDS sequence (opt4) from DENV-3__FJ639757__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacagcgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18126 - RNA, 9873 nt, synthetic construct
  misc_feature 1..9873: note = derived and/or modified CDS sequence (opt4) from DENV-3__FJ639758__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcagatgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18127 - RNA, 9873 nt, synthetic construct
  misc_feature 1..9873: note = derived and/or modified CDS sequence (opt4) from DENV-3__FJ639759__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggatccccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccagcgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18128 - RNA, 9873 nt, synthetic construct
  misc_feature 1..9873: note = derived and/or modified CDS sequence (opt4) from DENV-3__FJ639761__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctgcagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgtgatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcctgcagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18129 - RNA, 9873 nt, synthetic construct
  misc_feature 1..9873: note = derived and/or modified CDS sequence (opt4) from DENV-3__FJ639762__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaagatcgagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcatcttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18130 - RNA, 9873 nt, synthetic construct
  misc_feature 1..9873: note = derived and/or modified CDS sequence (opt4) from DENV-3__FJ639763__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggccgtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaacggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18131 - RNA, 9873 nt, synthetic construct
  misc_feature 1..9873: note = derived and/or modified CDS sequence (opt4) from DENV-3__FJ639765__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcatcctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18132 - RNA, 9873 nt, synthetic construct
  misc_feature 1..9873: note = derived and/or modified CDS sequence (opt4) from DENV-3__FJ639766__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18133 - RNA, 9873 nt, synthetic construct
  misc_feature 1..9873: note = derived and/or modified CDS sequence (opt4) from DENV-3__FJ639767__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccatcagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18134 - RNA, 9873 nt, synthetic construct
  misc_feature 1..9873: note = derived and/or modified CDS sequence (opt4) from DENV-3__FJ639768__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatccccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacatcgccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18135 - RNA, 9873 nt, synthetic construct
  misc_feature 1..9873: note = derived and/or modified CDS sequence (opt4) from DENV-3__FJ639769__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgtggtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18136 - RNA, 9873 nt, synthetic construct
  misc_feature 1..9873: note = derived and/or modified CDS sequence (opt4) from DENV-3__FJ882577__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcatcttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18137 - RNA, 9873 nt, synthetic construct
  misc_feature 1..9873: note = derived and/or modified CDS sequence (opt4) from DENV-3__FJ850096__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcctgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcaccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18138 - RNA, 9873 nt, synthetic construct
  misc_feature 1..9873: note = derived and/or modified CDS sequence (opt4) from DENV-3__FJ882578__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaatcctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18139 - RNA, 9873 nt, synthetic construct
  misc_feature 1..9873: note = derived and/or modified CDS sequence (opt4) from DENV-3__FJ639770__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccctgcagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18140 - RNA, 9873 nt, synthetic construct
  misc_feature 1..9873: note = derived and/or modified CDS sequence (opt4) from DENV-3__FJ639771__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgagagagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcctgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18141 - RNA, 9873 nt, synthetic construct
  misc_feature 1..9873: note = derived and/or modified CDS sequence (opt4) from DENV-3__FJ639772__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggatccccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccagcgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18142 - RNA, 9873 nt, synthetic construct
  misc_feature 1..9873: note = derived and/or modified CDS sequence (opt4) from DENV-3__FJ639774__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcaccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18143 - RNA, 9873 nt, synthetic construct
  misc_feature 1..9873: note = derived and/or modified CDS sequence (opt4) from DENV-3__FJ639775__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagccatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18144 - RNA, 9873 nt, synthetic construct
  misc_feature 1..9873: note = derived and/or modified CDS sequence (opt4) from DENV-3__FJ639777__SS-prME
  source 1..9873: mol_type = other RNA
accagcctgtgcctgatgatgaccctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtggccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagctgggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgaacgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatccccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacatcgccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgacccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaagccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacagactgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18145 - RNA, 9873 nt, synthetic construct
  misc_feature 1..9873: note = derived and/or modified CDS sequence (opt4) from DENV-3__FJ639778__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcagaatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatggtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgaagaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgagaagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18146 - RNA, 9873 nt, synthetic construct
  misc_feature 1..9873: note = derived and/or modified CDS sequence (opt4) from DENV-3__FJ639779__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagagaaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacttcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccgcccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccgccatgaagagattcagaaaggaggaggagagcgagggcgccatctggtga

SEQ ID NO: 18147 - RNA, 9873 nt, synthetic construct
  misc_feature 1..9873: note = derived and/or modified CDS sequence (opt4) from DENV-3__FJ639780__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcaccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcatcccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18148 - RNA, 9873 nt, synthetic construct
  misc_feature 1..9873: note = derived and/or modified CDS sequence (opt4) from DENV-3__FJ639781__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccagtacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacatcagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgccctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18149 - RNA, 9873 nt, synthetic construct
  misc_feature 1..9873: note = derived and/or modified CDS sequence (opt4) from DENV-3__FJ639782__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18150 - RNA, 9873 nt, synthetic construct
  misc_feature 1..9873: note = derived and/or modified CDS sequence (opt4) from DENV-3__FJ639785__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18151 - RNA, 9873 nt, synthetic construct
  misc_feature 1..9873: note = derived and/or modified CDS sequence (opt4) from DENV-3__FJ639786__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctgggccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaagaccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatcagcaccgccatccagcaggtgagaagcctgatcggcaacgaggagttcctggactacatgcccagcatgaagagattcagaaaggaggaggagagcgagggcgccatctggtga

SEQ ID NO: 18152 - RNA, 9873 nt, synthetic construct
  misc_feature 1..9873: note = derived and/or modified CDS sequence (opt4) from DENV-3__FJ639787__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggctgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18153 - RNA, 9873 nt, synthetic construct
  misc_feature 1..9873: note = derived and/or modified CDS sequence (opt4) from DENV-3__FJ639790__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccgccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18154 - RNA, 9873 nt, synthetic construct
  misc_feature 1..9873: note = derived and/or modified CDS sequence (opt4) from DENV-3__FJ639791__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccgtggagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagatctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatcagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcagcggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18155 - RNA, 9873 nt, synthetic construct
  misc_feature 1..9873: note = derived and/or modified CDS sequence (opt4) from DENV-3__FJ639792__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagagagacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18156 - RNA, 9873 nt, synthetic construct
  misc_feature 1..9873: note = derived and/or modified CDS sequence (opt4) from DENV-3__FJ639793__SS-prME
  source 1..9873: mol_type = other RNA
accagcctgtgcctgatgatgatcctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccaccagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcgtgatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18157 - RNA, 9873 nt, synthetic construct
  misc_feature 1..9873: note = derived and/or modified CDS sequence (opt4) from DENV-3__FJ639795__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcatcacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgctgaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18158 - RNA, 9873 nt, synthetic construct
  misc_feature 1..9873: note = derived and/or modified CDS sequence (opt4) from DENV-3__FJ639798__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccgtggagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacatcaacgccgagcccgagacccccaacatggacgtgatcggcgagagaatcaagagaatcaaggaggagcacaacagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18159 - RNA, 9873 nt, synthetic construct
  misc_feature 1..9873: note = derived and/or modified CDS sequence (opt4) from DENV-3__FJ639799__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcagagagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18160 - RNA, 9873 nt, synthetic construct
  misc_feature 1..9873: note = derived and/or modified CDS sequence (opt4) from DENV-3__FJ639800__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgaggtgcagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgagaatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcagcggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18161 - RNA, 9873 nt, synthetic construct
  misc_feature 1..9873: note = derived and/or modified CDS sequence (opt4) from DENV-3__FJ639801__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctgcaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagagactgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18162 - RNA, 9873 nt, synthetic construct
  misc_feature 1..9873: note = derived and/or modified CDS sequence (opt4) from DENV-3__KF955471__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcagcggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18163 - RNA, 9873 nt, synthetic construct
  misc_feature 1..9873: note = derived and/or modified CDS sequence (opt4) from DENV-3__FJ639803__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcagcggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18164 - RNA, 9873 nt, synthetic construct
  misc_feature 1..9873: note = derived and/or modified CDS sequence (opt4) from DENV-3__FJ639804__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagagccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcgagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaatccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgagaagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18165 - RNA, 9873 nt, synthetic construct
  misc_feature 1..9873: note = derived and/or modified CDS sequence (opt4) from DENV-3__FJ639805__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgagaagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcctgggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18166 - RNA, 9873 nt, synthetic construct
  misc_feature 1..9873: note = derived and/or modified CDS sequence (opt4) from DENV-3__FJ639807__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagagactgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18167 - RNA, 9873 nt, synthetic construct
  misc_feature 1..9873: note = derived and/or modified CDS sequence (opt4) from DENV-3__FJ639810__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttctgcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatgcccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgtacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18168 - RNA, 9873 nt, synthetic construct
  misc_feature 1..9873: note = derived and/or modified CDS sequence (opt4) from DENV-3__FJ639816__SS-prME
  source 1..9873: mol_type = other RNA
accagcctgtgcctgatgatgatcctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccaccatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcgtgatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18169 - RNA, 9873 nt, synthetic construct
  misc_feature 1..9873: note = derived and/or modified CDS sequence (opt4) from DENV-3__FJ639817__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcagaaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcagagagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18170 - RNA, 9873 nt, synthetic construct
  misc_feature 1..9873: note = derived and/or modified CDS sequence (opt4) from DENV-3__FJ639825__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggactacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagcagtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacaagcagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18171 - RNA, 9873 nt, synthetic construct
  misc_feature 1..9873: note = derived and/or modified CDS sequence (opt4) from DENV-3__FJ639826__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcaccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18172 - RNA, 9873 nt, synthetic construct
  misc_feature 1..9873: note = derived and/or modified CDS sequence (opt4) from DENV-3__FJ810416__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctgatgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccatcaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18173 - RNA, 9873 nt, synthetic construct
  misc_feature 1..9873: note = derived and/or modified CDS sequence (opt4) from DENV-3__GQ252678__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatcagcaccgccatccagcaggtgagaagcctgatcggcaacgaggagttcctggactacatgcccagcatgaagagattcagaaaggaggaggagagcgagggcgccatctggtga

SEQ ID NO: 18174 - RNA, 9873 nt, synthetic construct
  misc_feature 1..9873: note = derived and/or modified CDS sequence (opt4) from DENV-3__FJ850098__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggaccccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccctgcagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18175 - RNA, 9873 nt, synthetic construct
  misc_feature 1..9873: note = derived and/or modified CDS sequence (opt4) from DENV-3__KF955479__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatcgtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18176 - RNA, 9873 nt, synthetic construct
  misc_feature 1..9873: note = derived and/or modified CDS sequence (opt4) from DENV-3__FJ850109__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacaccggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacagcctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18177 - RNA, 9873 nt, synthetic construct
  misc_feature 1..9873: note = derived and/or modified CDS sequence (opt4) from DENV-3__GQ868586__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggactacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagcagtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgaggtgacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggagagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacaagcagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctggccaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18178 - RNA, 9873 nt, synthetic construct
  misc_feature 1..9873: note = derived and/or modified CDS sequence (opt4) from DENV-3__FJ850110__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18179 - RNA, 9873 nt, synthetic construct
  misc_feature 1..9873: note = derived and/or modified CDS sequence (opt4) from DENV-3__FJ850111__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacagcctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccagaatcgtgaccgccgagacccagaacagcagcttcatcatcgacggccccaacacccccgagtgccccaacaccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccaccgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagaagcatgcccggcaccagaagagtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18180 - RNA, 9873 nt, synthetic construct
  misc_feature 1..9873: note = derived and/or modified CDS sequence (opt4) from DENV-3__KF955486__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagaaggacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18181 - RNA, 9873 nt, synthetic construct
  misc_feature 1..9873: note = derived and/or modified CDS sequence (opt4) from DENV-3__FJ898468__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtggtggagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaaccccagactgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18182 - RNA, 9873 nt, synthetic construct
  misc_feature 1..9873: note = derived and/or modified CDS sequence (opt4) from DENV-3__FJ898469__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcctgcagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18183 - RNA, 9873 nt, synthetic construct
  misc_feature 1..9873: note = derived and/or modified CDS sequence (opt4) from DENV-3__FJ898470__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccgccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18184 - RNA, 9873 nt, synthetic construct
  misc_feature 1..9873: note = derived and/or modified CDS sequence (opt4) from DENV-3__FJ898471__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgatccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18185 - RNA, 9873 nt, synthetic construct
  misc_feature 1..9873: note = derived and/or modified CDS sequence (opt4) from DENV-3__FJ898472__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcctgaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18186 - RNA, 9873 nt, synthetic construct
  misc_feature 1..9873: note = derived and/or modified CDS sequence (opt4) from DENV-3__FJ898474__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcatgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccatcaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagggcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatcggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccatcaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagagcccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18187 - RNA, 9873 nt, synthetic construct
  misc_feature 1..9873: note = derived and/or modified CDS sequence (opt4) from DENV-3__EU529688__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18188 - RNA, 9873 nt, synthetic construct
  misc_feature 1..9873: note = derived and/or modified CDS sequence (opt4) from DENV-3__EU482613__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18189 - RNA, 9873 nt, synthetic construct
  misc_feature 1..9873: note = derived and/or modified CDS sequence (opt4) from DENV-3__EU529690__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18190 - RNA, 9873 nt, synthetic construct
  misc_feature 1..9873: note = derived and/or modified CDS sequence (opt4) from DENV-3__EU529691__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacagcggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccgtgggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18191 - RNA, 9873 nt, synthetic construct
  misc_feature 1..9873: note = derived and/or modified CDS sequence (opt4) from DENV-3__EU569689__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaaggcctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacctggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18192 - RNA, 9873 nt, synthetic construct
  misc_feature 1..9873: note = derived and/or modified CDS sequence (opt4) from DENV-3__EU482614__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18193 - RNA, 9873 nt, synthetic construct
  misc_feature 1..9873: note = derived and/or modified CDS sequence (opt4) from DENV-3__EU569690__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggagcagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgatcccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18194 - RNA, 9873 nt, synthetic construct
  misc_feature 1..9873: note = derived and/or modified CDS sequence (opt4) from DENV-3__EU569691__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcaccaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcaccctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccacccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacagaacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18195 - RNA, 9873 nt, synthetic construct
  misc_feature 1..9873: note = derived and/or modified CDS sequence (opt4) from DENV-3__EU482452__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctggacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggcctgaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgagccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18196 - RNA, 9873 nt, synthetic construct
  misc_feature 1..9873: note = derived and/or modified CDS sequence (opt4) from DENV-3__EU482453__SS-prME
  source 1..9873: mol_type = other RNA
accagcctgtgcctgatcatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccaccaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagctggagggcgccatctggtga

SEQ ID NO: 18197 - RNA, 9873 nt, synthetic construct
  misc_feature 1..9873: note = derived and/or modified CDS sequence (opt4) from DENV-3__EU482454__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccaagggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggtggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagagagagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaagagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatgggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagagaatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgcccactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18198 - RNA, 9873 nt, synthetic construct
  misc_feature 1..9873: note = derived and/or modified CDS sequence (opt4) from DENV-3__EU482455__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctggtggccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccttcgacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcatcggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18199 - RNA, 9873 nt, synthetic construct
  misc_feature 1..9873: note = derived and/or modified CDS sequence (opt4) from DENV-3__EU482456__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaccgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18200 - RNA, 9873 nt, synthetic construct
  misc_feature 1..9873: note = derived and/or modified CDS sequence (opt4) from DENV-3__EU482457__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcatcctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacagactggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatggtgaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcggccccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacaacgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18201 - RNA, 9873 nt, synthetic construct
  misc_feature 1..9873: note = derived and/or modified CDS sequence (opt4) from DENV-3__EU482458__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctgaccaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcatgagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccatcaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18202 - RNA, 9873 nt, synthetic construct
  misc_feature 1..9873: note = derived and/or modified CDS sequence (opt4) from DENV-3__EU482459__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18203 - RNA, 9873 nt, synthetic construct
  misc_feature 1..9873: note = derived and/or modified CDS sequence (opt4) from DENV-3__EU482460__SS-prME
  source 1..9873: mol_type = other RNA
accagcctgtgcctgatgatgatgctgcccgccaccttcgccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcaccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacagattccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctggccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccatgggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgaccccaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18204 - RNA, 9873 nt, synthetic construct
  misc_feature 1..9873: note = derived and/or modified CDS sequence (opt4) from DENV-3__EU482461__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18205 - RNA, 9873 nt, synthetic construct
  misc_feature 1..9873: note = derived and/or modified CDS sequence (opt4) from DENV-3__EU482462__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccagaaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggacctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggaaggacatggcccacaccttcatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctggtgctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccatcagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18206 - RNA, 9873 nt, synthetic construct
  misc_feature 1..9873: note = derived and/or modified CDS sequence (opt4) from DENV-3__EU660407__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagaacgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagagagtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18207 - RNA, 9873 nt, synthetic construct
  misc_feature 1..9873: note = derived and/or modified CDS sequence (opt4) from DENV-3__EU660409__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccaccagactggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagtacgagaacctgaagtacaccgtgatcatcaccgtgcacaccggcgaccagcaccaggtgggcaacgacacccagggcgccaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgccctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatggccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggtggccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgaccgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18208 - RNA, 9873 nt, synthetic construct
  misc_feature 1..9873: note = derived and/or modified CDS sequence (opt4) from DENV-3__EU660410__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccagaaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccttcatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctggtgctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgcccccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccatcagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18209 - RNA, 9873 nt, synthetic construct
  misc_feature 1..9873: note = derived and/or modified CDS sequence (opt4) from DENV-3__EU660411__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaagatcgtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccatcaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18210 - RNA, 9873 nt, synthetic construct
  misc_feature 1..9873: note = derived and/or modified CDS sequence (opt4) from DENV-3__FJ432722__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgtgatctggtga

SEQ ID NO: 18211 - RNA, 9873 nt, synthetic construct
  misc_feature 1..9873: note = derived and/or modified CDS sequence (opt4) from DENV-3__FJ432728__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgaggactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18212 - RNA, 9873 nt, synthetic construct
  misc_feature 1..9873: note = derived and/or modified CDS sequence (opt4) from DENV-3__FJ432731__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggcccagaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatgaccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18213 - RNA, 9873 nt, synthetic construct
  misc_feature 1..9873: note = derived and/or modified CDS sequence (opt4) from DENV-3__FJ562097__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccgccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18214 - RNA, 9873 nt, synthetic construct
  misc_feature 1..9873: note = derived and/or modified CDS sequence (opt4) from DENV-3__FJ432741__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtggccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgcacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatggtgatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggaggtgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagaaagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18215 - RNA, 9873 nt, synthetic construct
  misc_feature 1..9873: note = derived and/or modified CDS sequence (opt4) from DENV-3__FJ562099__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18216 - RNA, 9873 nt, synthetic construct
  misc_feature 1..9873: note = derived and/or modified CDS sequence (opt4) from DENV-3__KF955457__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgccaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacttcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgaggactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggacagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18217 - RNA, 9873 nt, synthetic construct
  misc_feature 1..9873: note = derived and/or modified CDS sequence (opt4) from DENV-3__FJ562100__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgaccgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18218 - RNA, 9873 nt, synthetic construct
  misc_feature 1..9873: note = derived and/or modified CDS sequence (opt4) from DENV-3__FJ547062__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcagcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18219 - RNA, 9873 nt, synthetic construct
  misc_feature 1..9873: note = derived and/or modified CDS sequence (opt4) from DENV-3__FJ461322__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgaggtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacatcccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18220 - RNA, 9873 nt, synthetic construct
  misc_feature 1..9873: note = derived and/or modified CDS sequence (opt4) from DENV-3__KF955458__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgaacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctgatgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18221 - RNA, 9873 nt, synthetic construct
  misc_feature 1..9873: note = derived and/or modified CDS sequence (opt4) from DENV-3__FJ562102__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccttcatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18222 - RNA, 9873 nt, synthetic construct
  misc_feature 1..9873: note = derived and/or modified CDS sequence (opt4) from DENV-3__FJ410229__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18223 - RNA, 9873 nt, synthetic construct
  misc_feature 1..9873: note = derived and/or modified CDS sequence (opt4) from DENV-3__FJ461326__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcagcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccagaaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaaagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18224 - RNA, 9873 nt, synthetic construct
  misc_feature 1..9873: note = derived and/or modified CDS sequence (opt4) from DENV-3__FJ461329__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgaggactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18225 - RNA, 9873 nt, synthetic construct
  misc_feature 1..9873: note = derived and/or modified CDS sequence (opt4) from DENV-3__KF955459__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcgccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18226 - RNA, 9873 nt, synthetic construct
  misc_feature 1..9873: note = derived and/or modified CDS sequence (opt4) from DENV-3__FJ547066__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgagatggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgagggcttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18227 - RNA, 9873 nt, synthetic construct
  misc_feature 1..9873: note = derived and/or modified CDS sequence (opt4) from DENV-3__KF955460__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcaacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagaaggacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacatcccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18228 - RNA, 9873 nt, synthetic construct
  misc_feature 1..9873: note = derived and/or modified CDS sequence (opt4) from DENV-3__FJ461334__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcacccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcatcctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18229 - RNA, 9873 nt, synthetic construct
  misc_feature 1..9873: note = derived and/or modified CDS sequence (opt4) from DENV-3__FJ461337__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcatgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgaggactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccgccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18230 - RNA, 9873 nt, synthetic construct
  misc_feature 1..9873: note = derived and/or modified CDS sequence (opt4) from DENV-3__FJ461338__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctggtggccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18231 - RNA, 9873 nt, synthetic construct
  misc_feature 1..9873: note = derived and/or modified CDS sequence (opt4) from DENV-3__FJ562103__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacagatgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcaccctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcaacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagaaggacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacatcccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18232 - RNA, 9873 nt, synthetic construct
  misc_feature 1..9873: note = derived and/or modified CDS sequence (opt4) from DENV-3__FJ898456__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcatcctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcttcttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgcccagcctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagagcttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcaacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggagagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaagactggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18233 - RNA, 9873 nt, synthetic construct
  misc_feature 1..9873: note = derived and/or modified CDS sequence (opt4) from DENV-3__JN697379__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccagccaggccagcaccgccgaggtgatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctgaagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacagaaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgtggtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcgtgctggagcagggcaagagaaccctgaccccccagcccatggagctgaagtacagctggaagacctggggcaaggccaagatcgtgaccgccgagacccagaacagcagcttcatcatcgacggccccagcacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcagcgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggccagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgtgagcgacagaatgggcatgggcgtgacctacctggccctgatcgccaccttcaagatccagcccttcctggccctgggcttcttcctgagaaagctgaccagcagagagaacctgctgctgggcgtgggcctggccatggccgccaccctgagactgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctggccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggtgctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccaccccctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggaccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18234 - RNA, 9873 nt, synthetic construct
  misc_feature 1..9873: note = derived and/or modified CDS sequence (opt4) from DENV-3__JQ045687__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctggtggccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccaccatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18235 - RNA, 9873 nt, synthetic construct
  misc_feature 1..9873: note = derived and/or modified CDS sequence (opt4) from DENV-3__JQ045689__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacagttcgagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgacccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacatcccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18236 - RNA, 9873 nt, synthetic construct
  misc_feature 1..9873: note = derived and/or modified CDS sequence (opt4) from DENV-3__JQ045691__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacatcggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagatcagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagaagagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgctgagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagcagcaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagagccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacagccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18237 - RNA, 9873 nt, synthetic construct
  misc_feature 1..9873: note = derived and/or modified CDS sequence (opt4) from DENV-3__JQ045692__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagatcagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgaggcccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccttcctgctgctgggcctgatgatcctgctgaccggcggcgccatgctgttcctgctgagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcaaggacgtgttctacctgccccccgagaagtgcgacaccctgctgtgcgacatcggcgagagcagccccagcagcaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagagccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18238 - RNA, 9873 nt, synthetic construct
  misc_feature 1..9873: note = derived and/or modified CDS sequence (opt4) from DENV-3__JQ045694__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgccatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccatcagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatgagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcccccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacctggtgaagctgatgagcggcagagacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccgagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18239 - RNA, 9873 nt, synthetic construct
  misc_feature 1..9873: note = derived and/or modified CDS sequence (opt4) from DENV-3__GU363549__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccatccagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgagacacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacccacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatgaaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatcagcaccgccatccagcaggtgagaagcctgatcggcaacgaggagttcctggactacatgcccagcatgaagagattcagaaaggaggaggagagcgagggcgccatctggtga

SEQ ID NO: 18240 - RNA, 9873 nt, synthetic construct
  misc_feature 1..9873: note = derived and/or modified CDS sequence (opt4) from DENV-3__KJ622197__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcaaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18241 - RNA, 9873 nt, synthetic construct
  misc_feature 1..9873: note = derived and/or modified CDS sequence (opt4) from DENV-3__KJ622198__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcaaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcctgcccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18242 - RNA, 9873 nt, synthetic construct
  misc_feature 1..9873: note = derived and/or modified CDS sequence (opt4) from DENV-3__KJ622191__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgaggtgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccatgggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18243 - RNA, 9873 nt, synthetic construct
  misc_feature 1..9873: note = derived and/or modified CDS sequence (opt4) from DENV-3__KJ622192__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18244 - RNA, 9873 nt, synthetic construct
  misc_feature 1..9873: note = derived and/or modified CDS sequence (opt4) from DENV-3__KJ622193__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcagggcgtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18245 - RNA, 9873 nt, synthetic construct
  misc_feature 1..9873: note = derived and/or modified CDS sequence (opt4) from DENV-3__KJ622194__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacagcggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacgccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18246 - RNA, 9873 nt, synthetic construct
  misc_feature 1..9873: note = derived and/or modified CDS sequence (opt4) from DENV-3__KJ622195__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcgacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcaaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18247 - RNA, 9873 nt, synthetic construct
  misc_feature 1..9873: note = derived and/or modified CDS sequence (opt4) from DENV-3__KJ622196__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccatcaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcaaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccacatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18248 - RNA, 9873 nt, synthetic construct
  misc_feature 1..9873: note = derived and/or modified CDS sequence (opt4) from DENV-3__KJ830751__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctgggccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagagctgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgtacgaggaggtgatgagaggcaagttcggcaagaagcacatgatcgccggcgtgttcttcaccttcgtgctgctgctgagcggccagatcacctggagaaacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgacgacatcgagcagatggccaacggcatcgccctgggcctgatggccctgaagctgatcacccagttcgagacctaccagctgtggaccgccctggtgagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcaacctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagatcgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcctgcccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgaggtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtggtgcccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcatccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgaccaaggccgacctggagaacagccacctgcccgagaagaagatcacccagtggctggagaccaagggcgtggagagactgaagagaatggccatcagcggcgacgactgcgtggtgaagcccatcgacgacagattcgccaacgccctggtggccctgaacgacatgggcaaggtgagaaaggacatcccccagtggcagcccagcagaggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggagaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18249 - RNA, 9873 nt, synthetic construct
  misc_feature 1..9873: note = derived and/or modified CDS sequence (opt4) from DENV-3__KC762681__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggacctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatgttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgcccacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaagaccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18250 - RNA, 9873 nt, synthetic construct
  misc_feature 1..9873: note = derived and/or modified CDS sequence (opt4) from DENV-3__KC762684__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgagcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagatgcagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccatcaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagagagaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctggtgacccagttcgagacctaccagctgtggaccgccctggtgagcctgatgtgcagcaacaccatcttcaccctgaccgtggcctggagaaccgccaccctgatcctggccggcatcagcctgctgcccctgtgccagagcagcggcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccagcgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgtgatgctgttcctgatcagcggcaagggcgtgggcaagaccagcatcggcctgatctgcgtggtggccagcagcagcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18251 - RNA, 9873 nt, synthetic construct
  misc_feature 1..9873: note = derived and/or modified CDS sequence (opt4) from DENV-3__KC762686__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccatcaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccaccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgcccacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggagcccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18252 - RNA, 9873 nt, synthetic construct
  misc_feature 1..9873: note = derived and/or modified CDS sequence (opt4) from DENV-3__KC762685__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcaccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgcccacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggagcccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18253 - RNA, 9873 nt, synthetic construct
  misc_feature 1..9873: note = derived and/or modified CDS sequence (opt4) from DENV-3__KC762687__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtggtgaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgttccccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgtgcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacaagaccagaagcgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18254 - RNA, 9873 nt, synthetic construct
  misc_feature 1..9873: note = derived and/or modified CDS sequence (opt4) from DENV-3__KC762688__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccctgttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgcccacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagttccccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagaagggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatcgaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18255 - RNA, 9873 nt, synthetic construct
  misc_feature 1..9873: note = derived and/or modified CDS sequence (opt4) from DENV-3__KC762689__SS-prME
  source 1..9873: mol_type = other RNA
accagcctgtgcctgatgatgatgatccccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagagctgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtggtggccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgacctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgtgcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaaggtggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18256 - RNA, 9873 nt, synthetic construct
  misc_feature 1..9873: note = derived and/or modified CDS sequence (opt4) from DENV-3__KC762690__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagttcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccgtgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgcccacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgaggagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggccatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagcttcagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggagcccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaaggccgacctggagaacccccacctgctggagaaggagatcacccagtggctggagaccaagggcgtggagagactgaagagaatggccatcagcggcgacgactgcgtggtgaagcccatcgacgacagattcgccgacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctggccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18257 - RNA, 9873 nt, synthetic construct
  misc_feature 1..9873: note = derived and/or modified CDS sequence (opt4) from DENV-3__KC762691__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaaggacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacaccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccagaagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcgccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgttccccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagaatcggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18258 - RNA, 9873 nt, synthetic construct
  misc_feature 1..9873: note = derived and/or modified CDS sequence (opt4) from DENV-3__KC762692__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgtgggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggtgctgaagctgatcacccagttcgagacctaccagctgtggaccgccctggtgagcctgacctgcagcaacaccatcttcaccctgaccgtggcctggagaaccgccaccctgatcctggccggcaccagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccatcaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccaccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaagatcatggagatcaccgccggctggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaacctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgagaacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18259 - RNA, 9873 nt, synthetic construct
  misc_feature 1..9873: note = derived and/or modified CDS sequence (opt4) from DENV-3__JQ920481__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18260 - RNA, 9873 nt, synthetic construct
  misc_feature 1..9873: note = derived and/or modified CDS sequence (opt4) from DENV-3__JQ920483__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcagaaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagagaaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18261 - RNA, 9873 nt, synthetic construct
  misc_feature 1..9873: note = derived and/or modified CDS sequence (opt4) from DENV-3__JQ920482__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18262 - RNA, 9873 nt, synthetic construct
  misc_feature 1..9873: note = derived and/or modified CDS sequence (opt4) from DENV-3__JQ920484__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18263 - RNA, 9873 nt, synthetic construct
  misc_feature 1..9873: note = derived and/or modified CDS sequence (opt4) from DENV-3__JQ920486__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgtggacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaatcgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18264 - RNA, 9873 nt, synthetic construct
  misc_feature 1..9873: note = derived and/or modified CDS sequence (opt4) from DENV-3__JQ920485__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagcacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccatccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaatcgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatgaacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagcccgagggcgccatctggtga

SEQ ID NO: 18265 - RNA, 9873 nt, synthetic construct
  misc_feature 1..9873: note = derived and/or modified CDS sequence (opt4) from DENV-3__FJ644564__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctggagaacctggagctggacttcacctactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcatcctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgagcgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggctggtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcagcagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18266 - RNA, 9873 nt, synthetic construct
  misc_feature 1..9873: note = derived and/or modified CDS sequence (opt4) from DENV-3__HQ235027__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccatcgagatccagaacagcggcggcaccagcatcttcgccggccacctgaagtgcagactgaagatggacaagctggagctgaagggcatgagctacgccatgtgcaccaagaccttcgtgctgaagaaggaggtgagcgagacccagcacggcaccatcctgatcaaggtggagtacaagggcgaggacgccccctgcaagatccccttcagcaccgaggacggccagggcaaggcctacaacggcagactgatcaccgccaaccccgtggtgaccaagaaggacgagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacatcagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctggtggtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacagatacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaagatcctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18267 - RNA, 9873 nt, synthetic construct
  misc_feature 1..9873: note = derived and/or modified CDS sequence (opt4) from DENV-3__JQ920476__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagagcggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18268 - RNA, 9873 nt, synthetic construct
  misc_feature 1..9873: note = derived and/or modified CDS sequence (opt4) from DENV-3__JQ920477__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcagcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18269 - RNA, 9873 nt, synthetic construct
  misc_feature 1..9873: note = derived and/or modified CDS sequence (opt4) from DENV-3__JQ920478__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcagaggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacctggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18270 - RNA, 9873 nt, synthetic construct
  misc_feature 1..9873: note = derived and/or modified CDS sequence (opt4) from DENV-3__JQ920480__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgactacggcaccctgggcctggagtgcagccccagaaccggcctggacttcaacgagatgatcctgctgaccatgaagaacaaggcctggatggtgcacagacagtggttcctggacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacgagagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcatgttcgtgctgctgctgagcggccagatcacctggagagacatggtgcacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18271 - RNA, 9873 nt, synthetic construct
  misc_feature 1..9873: note = derived and/or modified CDS sequence (opt4) from DENV-3__JQ920479__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcctggacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacgagagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcatgttcgtgctgctgctgagcggccagatcacctggagagacatggtgcacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactacagcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18272 - RNA, 9873 nt, synthetic construct
  misc_feature 1..9873: note = derived and/or modified CDS sequence (opt4) from DENV-3__KU216208__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctggatcgacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacgcctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtggtgaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgagaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcctacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatggccacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18273 - RNA, 9873 nt, synthetic construct
  misc_feature 1..9873: note = derived and/or modified CDS sequence (opt4) from DENV-3__GU370053__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctgggccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagagctgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgtacgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgaggtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtggtgcccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcatccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgaccaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcagaggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggagaacccctggatggaggacaagacccccgtgaccacctgggagaacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18274 - RNA, 9873 nt, synthetic construct
  misc_feature 1..9873: note = derived and/or modified CDS sequence (opt4) from DENV-3__JQ411814__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcatcggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagacgtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcctgaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatgggcatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagacaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggtgcagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18275 - RNA, 9873 nt, synthetic construct
  misc_feature 1..9873: note = derived and/or modified CDS sequence (opt4) from DENV-3__KM190937__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccatcgccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagatgcagggcgtgaccgccgagatcaccccccaggccagcaccgccgaggtgatcctgcccgagtacggcaccctgggcctggagtgcagccccagaaccggcctggacttcaacgagatgatcagcctgaccatgaagaacaaggcctggatggtgcacagacagtggttcttcgacctgcccctgccctggaccagcggcgccaccgccgagacccccacctggaacagaaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgagcagcttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcaccggcgtgctggagcagggcaagagaaccctgaccccccagcccatggagctgaagtacagctggaagacctggggcaaggccaagatcgtgaccgccgagacccagaacagcagcttcatcatcgacggccccagcacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcagcgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggccagcgccggcagcggcaaggtggacaacttcaccatgggcgtgctgtgcctggccatcctgttcgaggaggtgatgagaggcaagttcggcaagatccacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccgccaccctgagactgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgcccagcccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatggtgaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctggccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggtgctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccaccccctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18276 - RNA, 9873 nt, synthetic construct
  misc_feature 1..9873: note = derived and/or modified CDS sequence (opt4) from DENV-3__JQ920487__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18277 - RNA, 9873 nt, synthetic construct
  misc_feature 1..9873: note = derived and/or modified CDS sequence (opt4) from DENV-3__JQ920488__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacgagagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgggcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18278 - RNA, 9873 nt, synthetic construct
  misc_feature 1..9873: note = derived and/or modified CDS sequence (opt4) from DENV-3__JQ920489__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccagagagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaatcgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatgaacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18279 - RNA, 9873 nt, synthetic construct
  misc_feature 1..9873: note = derived and/or modified CDS sequence (opt4) from DENV-3__KF824902__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagacccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgagggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggtgctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcatgggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18280 - RNA, 9873 nt, synthetic construct
  misc_feature 1..9873: note = derived and/or modified CDS sequence (opt4) from DENV-3__KF824903__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgaccatcaccgtgcacaccggcgaccagcaccaggtgggcaacgacacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcggcggcgtgagctggatcatgaagatcggcatcggcgtgctgctgacctggatcggcctgaacagcaagaacaccagcatgagcttcagctgcatcgtgatcggcatcatcaccctgtacctgggcaccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagagccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagacctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccgtggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcagaaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccaggccaacgccgagcccgagggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggagtgcatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaagagagttcgagctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacaccgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggagagcgccagagccgccgtggaggacgaggagttctggaagctggtgggcagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18281 - RNA, 9873 nt, synthetic construct
  misc_feature 1..9873: note = derived and/or modified CDS sequence (opt4) from DENV-3__JF504679__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgtgatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccgtgagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagagagaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccatccagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatgaaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18282 - RNA, 9873 nt, synthetic construct
  misc_feature 1..9873: note = derived and/or modified CDS sequence (opt4) from DENV-3__KC425219__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaaccccaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18283 - RNA, 9873 nt, synthetic construct
  misc_feature 1..9873: note = derived and/or modified CDS sequence (opt4) from DENV-3__AY858037__SS-prME
  source 1..9873: mol_type = other RNA
accagcctgtgcctgatgatgatgctgcccgtgaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacagagccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgttccccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18284 - RNA, 9873 nt, synthetic construct
  misc_feature 1..9873: note = derived and/or modified CDS sequence (opt4) from DENV-3__KJ737429__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18285 - RNA, 9873 nt, synthetic construct
  misc_feature 1..9873: note = derived and/or modified CDS sequence (opt4) from DENV-3__DQ863638__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatcctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggcccccacacccccgagtgccccagagccagcagagcctggaacgtgtgggaggtggaggactacggcttcggcgtgttcaccaccaacatctggctgaagctgagagaggagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggccagcgccggcagcggcaaggtggacaacttcaccatgggcttcctgtgcctggccatcctgttcgaggaggtgatgagaggcaagttcggcaagaagcacatgatcgccggcgtgttcctgaccttcctgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacttcctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcagaggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggccacccactacgccatcatcggccccggcctgcaggccaaggccaccagagaggcccagaagagaaccgccgccggcatcaccaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcaccagacacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcttcaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagcagaggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcaagaaggaggaggagagcgagggcgccatctggtga

SEQ ID NO: 18286 - RNA, 9873 nt, synthetic construct
  misc_feature 1..9873: note = derived and/or modified CDS sequence (opt4) from DENV-3__KJ737430__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatggccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatggccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgatccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18287 - RNA, 9873 nt, synthetic construct
  misc_feature 1..9873: note = derived and/or modified CDS sequence (opt4) from DENV-3__AY858040__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagaagcagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgatgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcctactggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccgtgagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagacccaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggagcccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgaggacgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18288 - RNA, 9873 nt, synthetic construct
  misc_feature 1..9873: note = derived and/or modified CDS sequence (opt4) from DENV-3__AY858041__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggccaggcccacaacggcagactgatcaccgccaaccccgtggtgaccaagaaggaggagcccgtgaacatcgaggccgagagccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgacgacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggaagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18289 - RNA, 9873 nt, synthetic construct
  misc_feature 1..9873: note = derived and/or modified CDS sequence (opt4) from DENV-3__KC261634__SS-prME
  source 1..9873: mol_type = other RNA
accagcatctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacagacccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcagagtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcaccggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggcccaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacgcccccaagaagagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgccgtgagcagcaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagagactgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatggagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacagactgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaagactggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggaggacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18290 - RNA, 9873 nt, synthetic construct
  misc_feature 1..9873: note = derived and/or modified CDS sequence (opt4) from DENV-3__JN662391__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacgagcagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagatgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcctgaccttcatgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccatccagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatcaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacccacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatgaaccccgagcacagactgctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatcagcaccgccatccagcaggtgagaagcctgatcggcaacgaggagttcctggactacatgcccagcatgaagagattcagaaaggaggaggagagcgagggcgccatctggtga

SEQ ID NO: 18291 - RNA, 9873 nt, synthetic construct
  misc_feature 1..9873: note = derived and/or modified CDS sequence (opt4) from DENV-3__AY858043__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggccgagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcagacacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggtgcacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaaggtggtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggagaaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccttcctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcatccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcagaggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18292 - RNA, 9873 nt, synthetic construct
  misc_feature 1..9873: note = derived and/or modified CDS sequence (opt4) from DENV-3__AY858044__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccggctggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18293 - RNA, 9873 nt, synthetic construct
  misc_feature 1..9873: note = derived and/or modified CDS sequence (opt4) from DENV-3__AY858045__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccatcttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcgagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagagactgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccggctggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18294 - RNA, 9873 nt, synthetic construct
  misc_feature 1..9873: note = derived and/or modified CDS sequence (opt4) from DENV-3__AY858046__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccatcacctacaagtgccccctgatcaccgaggtggagcccgaggacatcgactgctggtgcaacctgaccagcacctgggtgacctacggcacctgcaaccaggtgggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatgttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcatgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgagaagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggccatggagatcaccgccggctggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagcagggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggtgcagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18295 - RNA, 9873 nt, synthetic construct
  misc_feature 1..9873: note = derived and/or modified CDS sequence (opt4) from DENV-3__AY858047__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcatcctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacagccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccctgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagagaacccagagaagcggcgtgctgtgggacgtgcccagcccccccgagacccagaaggccgagctggaggagggcgtgtacagaatcaagcagcagggcatcctgggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgtgatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggccagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccgccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgatcgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18296 - RNA, 9873 nt, synthetic construct
  misc_feature 1..9873: note = derived and/or modified CDS sequence (opt4) from DENV-3__HQ332170__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggactacaagggcgaggacgtgccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacaccggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagcagtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcgaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcaaggcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaagcatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacaagcagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18297 - RNA, 9873 nt, synthetic construct
  misc_feature 1..9873: note = derived and/or modified CDS sequence (opt4) from DENV-3__AY858038__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcagactgaccgtggtggtgggcgacaccatcggcgtgctgcagcagggcaagagaaccctgcccccccagcccatggagctgaagtacagctggaagacctggggcaaggccaagatcgtgaccgccaagacccagaacagcagcttcatcatcgacggccccaacacccccgagtggcccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctggtgacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgatctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcatcagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagagaaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18298 - RNA, 9873 nt, synthetic construct
  misc_feature 1..9873: note = derived and/or modified CDS sequence (opt4) from DENV-3__AY858039__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagagcccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagctgatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcagcaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcatcatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccaacgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcatcttcgtgctgctgctgagcggccagatcacctggagagacatggccagaaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccagccccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagagaggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgactggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcgtgggcaagaccagcatcggcctgatctgcgtggtggccagcagcggcatgctgtggatggccgacatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacctacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccaagcccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaagaccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18299 - RNA, 9873 nt, synthetic construct
  misc_feature 1..9873: note = derived and/or modified CDS sequence (opt4) from DENV-3__JN368477__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagagcaagcccaccctggacatcgagctgcagaagaccgaggccacccagctggccaccctgagaaagctgtgcatcgagggcaagatcaccaacatcaccaccgacagcagatgccccacccagggcgaggccaccctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcgccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacccacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctggtgatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgagaaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacaaggagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccggccacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactggatccccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagaccgagggcgccatctggtga

SEQ ID NO: 18300 - RNA, 9873 nt, synthetic construct
  misc_feature 1..9873: note = derived and/or modified CDS sequence (opt4) from DENV-3__EF643017__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagagaagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcaccaccgaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcagcggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacagaggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcacccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgttcttcaccttcgtgctgctgctgagcggccagatcacctggagagacatgacccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgacctgcagcaacaccatgttcaccctgaccgtggcctggagaaccgccaccctgatcctggccggcgtgagcctgctgcccgtgtgccagagcagcagcatgagaaagaccgactggctgcccatggccgtggccgccatgggcgtgagccccctgcccctgttcatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacatcaccagagaggaggaggccgagcagaccggcgtgagccacaacctgatgaccaccgtggacgacgacggcaccatgagaatcaaggacgacgagaccgagaacatcctgaccgtgctgctgaagaccgccctgctgatcgtgagcggcgtgttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacctacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggccagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgagctggatggccgagatccccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgtgggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtggccagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagaagcatgcccggcaccagaagagtgatgggcatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccaaggccgccgtggaggacgaggacttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacaccggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18301 - RNA, 9873 nt, synthetic construct
  misc_feature 1..9873: note = derived and/or modified CDS sequence (opt4) from DENV-3__DQ675519__SS-prME
  source 1..9873: mol_type = other RNA
accagcatctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcagaatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcaacggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcgtggccctgggcctgatggccctgaagctgatcacccagttcgagacctaccagctgtggaccgccctggtgagcctgatgtgcagcaacaccatcttcaccctgaccgtggcctggagaaccgccaccctgatcctggccggcatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccatcggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcatccagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccaccatcgtgagagaggccatcaagagaagactgagaaccctgatcctggcccccaccagagtggtggccgccgagatggaggaggccctgaagggcctgcccatcagataccagaccaccgccaccaagagcgagcacaccggcaaggagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcctacagaaccagaagcgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccaaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccaccgtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagacccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgcccgagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18302 - RNA, 9873 nt, synthetic construct
  misc_feature 1..9873: note = derived and/or modified CDS sequence (opt4) from DENV-3__DQ675521__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcagagccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18303 - RNA, 9873 nt, synthetic construct
  misc_feature 1..9873: note = derived and/or modified CDS sequence (opt4) from DENV-3__DQ675522__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18304 - RNA, 9873 nt, synthetic construct
  misc_feature 1..9873: note = derived and/or modified CDS sequence (opt4) from DENV-3__DQ675527__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaatcaaccagatcctggaggagaacatggacgtggagatctggaccaaggagggcgagagaaagaacctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18305 - RNA, 9873 nt, synthetic construct
  misc_feature 1..9873: note = derived and/or modified CDS sequence (opt4) from DENV-3__DQ675528__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgtgctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18306 - RNA, 9873 nt, synthetic construct
  misc_feature 1..9873: note = derived and/or modified CDS sequence (opt4) from DENV-3__DQ675530__SS-prME
  source 1..9873: mol_type = other RNA
accagcttctgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagccccacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgacacccagggcgtgaccgtggagatcaccccccaggccagcaccgtggaggccgtgctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagatccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgtgggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccagcgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18307 - RNA, 9873 nt, synthetic construct
  misc_feature 1..9873: note = derived and/or modified CDS sequence (opt4) from DENV-3__DQ675533__SS-prME
  source 1..9873: mol_type = other RNA
accagcctgtgcctgatgatgatcctgcccgccgccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgcccccacatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccgacagcagatgccccacccagggcgaggccgtgctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagcaccaggtgggcaacgagacccagggcgtgaccgccgagatcaccccccaggccagcacccacgaggccctgctgcccgagtacggcaccctgggcctggagtgcagccccagaaccggcctggacttcaacgagatgatcctgctgaccatgaagaacaaggcctggatggtgcacagacagtggttcttcgacctgcccctgccctgggccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcaccaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaacgccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctgggtgatgaagatcggcatcggcgtgctgctgacctggatcggcctgaacagcaagaacaccagcatgagcttcagctgcatcgccatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacaccctgggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagagctgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcagcgagaaggaggagaacatggtgaagagcctggtgagcgccggcagcggcaaggtggacaacttcaccatgggcgtgctgtgcctggccatcctgttcgaggaggtgctgagaggcaagttcggcaagaagcacatgatcgccggcgtgttcttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccgtgtgccagagcagcagcatgagaaagaccgactggctgcccatgaccgtggccgccatgggcgtgccccccctgcccctgctgatcttcagcctgaaggacaccctgaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcaccttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgccagcagcggcatgctgtggatggccgaggtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcatcgccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctgatcacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtggtgcccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacaacagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccaaggccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcatccagcagatggaccccgagcacagacagctggccaacgccatcttcaagctgacctaccagaacaaggtggtgaaggtgcagagacccacccccaccggcaccgtgatggacatcatcagcagaaaggaccagagaggcagcggccaggtgggcacctacggcctgaacaccttcaccaacatggaggcccagctggtgagacagatggagggcgagggcgtgctgaccaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggagaacccctggatggaggacaagacccccgtgaccacctgggagaacgtgccctacctgggcaagagagaggaccagtggtgcggcagcctgatcggcctgaccagcagagccacctgggcccagaacatccccaccgccatccagcaggtgagaagcctgatcggcaacgaggagttcctggactacatgcccagcatgaagagattcagaaaggaggaggagagcgagggcgccatctggtga

SEQ ID NO: 18308 - RNA, 9873 nt, synthetic construct
  misc_feature 1..9873: note = derived and/or modified CDS sequence (opt4) from DENV-3__AY744677__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagagactgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18309 - RNA, 9873 nt, synthetic construct
  misc_feature 1..9873: note = derived and/or modified CDS sequence (opt4) from DENV-3__AY744678__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccagcgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18310 - RNA, 9873 nt, synthetic construct
  misc_feature 1..9873: note = derived and/or modified CDS sequence (opt4) from DENV-3__AY744679__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggtggtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggccaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacatcatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatgaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgagcacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18311 - RNA, 9873 nt, synthetic construct
  misc_feature 1..9873: note = derived and/or modified CDS sequence (opt4) from DENV-3__AY744680__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18312 - RNA, 9873 nt, synthetic construct
  misc_feature 1..9873: note = derived and/or modified CDS sequence (opt4) from DENV-3__AY744681__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcagaatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcagcgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagaagactggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18313 - RNA, 9873 nt, synthetic construct
  misc_feature 1..9873: note = derived and/or modified CDS sequence (opt4) from DENV-3__AY744682__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgaccatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcagcggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccctacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18314 - RNA, 9873 nt, synthetic construct
  misc_feature 1..9873: note = derived and/or modified CDS sequence (opt4) from DENV-3__AY744683__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagattcctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18315 - RNA, 9873 nt, synthetic construct
  misc_feature 1..9873: note = derived and/or modified CDS sequence (opt4) from DENV-3__AY744684__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagacccagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagagatgtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctggtgagcctgatgtgcagcaacaccatcagcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18316 - RNA, 9873 nt, synthetic construct
  misc_feature 1..9873: note = derived and/or modified CDS sequence (opt4) from DENV-3__AY744685__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcaccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccttcagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagagcatcgagggcaaggccgtgcagcacgagaacctgaagtacaccgtgatcatcaccgtgcacaccggcgaccagcaccaggtgggcaacgagatgcagggcgtgaccgccgagatcaccccccaggccagcaccgtggaggccatcctgcccgagtacggcaccctgggcctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacaagaaggagctgctggtgaccttcaagaacgcccacgccaagaagcaggaggtggtggtgctgggcagccaggagggcgccatgcacaccgccctgaccggcgccaccgagatccagaccagcggcggcaccagcatcttcgccggccacctgaagtgcagactgaagatggacaagctggagctgaagggcatgagctacgccatgtgcctgaacgccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccatcgtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacgccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccatcgtggtgggcgacgtgatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccctgagagcctggaacgtgtgggaggtggaggactacggcttcggcgtgttcaccaccaacatctggctgaagctgagagagaagtacacccagctgtgcgaccacagactgatgagcgccgccgtgaaggacgagagagccgtgcacgccgacatgggctactggatcgagagccagaagaacggcagctggaagctggagaaggccagcctgatcgaggtgaagacctgcacctggcccaagagccacaccctgtggagcaacggcgtgctggagagcgacatgatcatccccaagagcctggccggccccatcagccagcacaactacagacccggctaccacacccagaccgccggcccctggcacctgggcaagctggagctggacttcaactactgcgagggcaccaccgtggtgatcaccgagaactgcggcatcagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaagaccgacaacttcaccatgggcgtgctgtgcctggccatcctgttcgaggaggtgatgagaggcaagttcggcaagaagcacatgatcgccggcgccctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatggccctgaagctgatcacccagttcgagacctaccagctgtggaccgccctgatcagcctgatgtgcagcaacaccatcttcaccctgaccgtggcctggagaaccgccaccctgatcctggccgtgatcagcctgctgcccgtgtgccagagcagcagcatgagaaagaccgactggctgcccatgaccgtggccgccatgggcgtgccccccctgcccctgttcatcttcagcctgaaggacaccctgaagagaagaagctggcccctgaacgagggcgtgatggccgtgggcctggtgagcatcctggccagcagcttcctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccaacgtgaagaaggacctgatcagctacggcggcggctggaagctgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcgtgatggacgaggcccacttcaccgaccccgccagcatcgccgccagaggctacatcagcaccagagtgggcatgggcgaggccgccgccatcttcatgaccgccaccccccccggcaccgccgacgccttcccccagagcaacgcccccatccaggacgaggagagagacatccccgagagaagctggaacagcggcaacgagtggatcaccgacttcgccggcaagaccgtgtggttcgtgcccagcatcaaggccggcaacgacatcgccaactgcctgagaaagaacggcaagaaggtgatccagctgagcagaaagaccttcgacaccgagtaccagaagaccaagctgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgtggccagcgccgcccagagaagaggcagagtgggcagaaacagccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagaagaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtggtggccagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccttctgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagatcacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagcacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcagaagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcatcaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagccacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctgatcagacagatggagggcgagggcgtgctgagcaaggccgacctggagaacccccacctgctggagaagaaggtgacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgagagagaccgcctgcctgggcaaggcctacgcccagatgtgggccctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcaacgaggagttcctggactacatgcccagcatgaagagattcagaaaggaggaggagagcgagggcgccatctggtga

SEQ ID NO: 18317 - RNA, 9873 nt, synthetic construct
  misc_feature 1..9873: note = derived and/or modified CDS sequence (opt4) from DENV-3__AY876494__SS-prME
  source 1..9873: mol_type = other RNA
accagcctgtgcctgatgatgatgctgcccgccaccctggccttccacctgaccagcagagacggcgagcccagaatgatcgtggccaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacccgtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacgtgaccaccgacagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagcacgagaacctgaagtacaccgtgatcatcaccgtgcacaccggcgaccagcaccaggtgggcaacgacacccagggcgtgaccgtggagatcaccccccaggccagcaccgccgaggccatcctgcccgagtacggcaccctggtgctggagtgcagccccagaaccggcctggacttcaacgagatgatcctgctgaccatgaagaacaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctactacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaaccggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatccccaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcgtggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcgccggcctggccttcagcatcatgaagagcgtgggcaccggcaagagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagagacccagactgtgcaccagagaggagttcaccaagaaggtgagaaccaacgccgccatgggcgccgtgttcaccgaggagaaccagtgggacagcgccagagccgccgtggaggacgaggagttctggaacctgtgggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcaccccctggctggagcccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagaagcacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18318 - RNA, 9873 nt, synthetic construct
  misc_feature 1..9873: note = derived and/or modified CDS sequence (opt4) from DENV-3__AY923865__SS-prME
  source 1..9873: mol_type = other RNA
accagcctgtgcctgatgatgatgctgcccgccaccctggccttccacctgaccagcagagacggcgagcccagaatgatcgtgggcaagaacgagagaggcaagagcctgctgttcaagaccgccagcggcatcaacatgtgcaccctgatcgccatggacctgggcgagatgtgcgacgacaccgtgacctacaagtgccccctgatcgccgaggtggagcccgaggacatcgactgctggtgcaacctgaccagcacctgggtgacctacggcacctgcaaccaggccggcgagcacagaagagacaagagaagcgtggccctggccccccacgtgggcatgggcctggacaccagaacccagacctggatgagcgccgagggcgcctggagacaggtggagaaggtggagacctgggccctgagacaccccggcttcaccatcctggccctgttcctggcccactacatcggcaccagcctgacccagaaggtggtgatcttcatcctgctgatgctggtgacccccagcatgaccatgagatgcgtgggcgtgggcaacagagacttcgtggagggcctgagcggcgccacctgggtggacgtggtgctggagcacggcggctgcgtgaccaccatggccaagaacaagcccaccctggacatcgagctgcagaagaccgaggccacccagctggccaccctgagaaagctgtgcatcgagggcaagatcaccaacatcaccaccggcagcagatgccccacccagggcgaggccatcctgcccgaggagcaggaccagaactacgtgtgcaagcacacctacgtggacagaggctggggcaacggctgcggcctgttcggcaagggcagcctggtgacctgcgccaagttccagtgcctggagcccatcgagggcaaggtggtgcagtacgagaacctgaagtacaccgtgatcatcaccgtgcacaccggcgaccagccccaggtgggcaacgacacccagggcgtgaccgtggagatcaccccccaggccagcaccgtggaggccgtgctgctggagtacggcaccctgggcctgaagtgcagccccagaaccggcctggacttcaacgagatgatcctgctgaccatgaagaccaaggcctggatggtgcacagacagtggttcttcgacctgcccctgccctggaccagcggcgccaccaccgagacccccacctggaacagaaaggagctgctggtgaccttcaagaacgcccacgccaagaagcaggaggtggtggtgctgggcagccaggagggcgccatgcacaccgccctgaccggcgccaccgagatccagaacagcggcggcaccagcatcttcgccggccacctgaagtgcagactgaagatggacaagctggagctgaagggcatgagctacgccatgtgcctgaacaccttcgtgctgaagaaggaggtgagcgagacccagcacggcaccatcctgatcaaggtggagtacaagggcgaggacgccccctgcaagatccccttcagcaccgaggacggccagggcaaggcccacaacggcagactgatcaccgccaaccccgtggtgaccaagaaggaggagcccgtgaacatcgaggccgagccccccttcggcgagagcaacatcgtgatcggcatcggcgacaaggccctgaagatcaactggtacaagaagggcagcagcatcggcaagatgttcgaggccaccgccagaggcgccagaagaatggccatcctgggcgacaccgcctgggacttcggcagcgtgggcggcgtgctgaacagcctgggcaagatggtgcaccagatcttcggcagcgcctacaccgccctgttcagcggcgtgagctggatcatgaagatcggcatcggcgtgctgctgacctggatcggcctgaacagcaagaacaccagcatgagcttcagctgcatcgtgatcggcatcatcaccctgtacctgggcgccgtggtgcaggccgacatgggctgcgtgatcaactggaagggcaaggagctgaagtgcggcagcggcatcttcgtgaccaacgaggtgcacacctggaccgagcagtacaagttccaggccgacagccccaagagactggccaccgccatcgccggcgcctgggagaacggcgtgtgcggcatcagaagcaccaccagaatggagaacctgctgtggaagcagatcgccaacgagctgaactacatcctgtgggagaacaacatcaagctgaccgtggtggtgggcgacatcatcggcgtgctggagcagggcaagagaaccctgaccccccagcccatggagctgaagtacagctggaagacctggggcaaggccaagatcgtgaccgccgagacccagaacagcagcttcatcatcgacggccccaacacccccgagtgccccagcgccagcagagcctggaacgtgtgggaggtggaggactacggcttcggcgtgttcaccaccaacatctggctgaagctgagagaggtgtacacccagagctgcgaccacagactgatgagcgccgccatcaaggacgagagagccgtgcacgccgacatgggctactggatcgagagccagaagaacggcagctggaagctggagaaggccagcttcatcgaggtgaagacctgcacctggcccaagagccacaccctgtggagcaacggcgtgctggagagcgacatgatcatccccaagagcctggccggccccatcagccagcacaaccacagacccggctaccacacccagaccgccggcccctggcacctgggcaagctggagctggacttcaactactgcgagggcaccaccgtggtgatcaccgagaactgcggcaccagaggccccagcctgagaaccaccaccgtgagcggcaagctgatccacgagtggtgctgcagaagctgcaccctgccccccctgagatacatgggcgaggacggctgctggtacggcatggagatcagacccatcaacgagaaggaggagaacatggtgaagagcctggtgagcgccggcagcggcaaggtggacaacttcaccatgggcgtgctgtgcctggccatcctgttcgaggaggtgatgagaggcaagttcggcaagaagcacatgatcgccggcgtgctgttcaccttcgtgctgctgctgagcggccagatcacctggagagacatggcccacaccctgatcatgatcggcagcaacgccagcgacagaatgggcatgggcgtgacctacctggccctgatcgccaccttcaagatccagcccttcctggccctgggcttcttcctgagaaagctgaccagcagagagaacctgctgctgggcgtgggcctggccatggccaccaccctgcagctgcccgaggacatcgagcagatggccaacggcatcgccctgggcctgatgaccctgaagctgatcacccagttcgagacctaccagctgtggaccgccctggtgagcctgacctgcagcaacaccatcttcaccctgaccgtggcctggagaaccgccaccctgatcctggccggcgtgagcctgctgcccctgtgccagagcagcagcatgagaaagaccgactggctgcccatgaccgtggccgccatgggcgtgccccccctgcccctgttcatcttcagcctgaaggacacccccaagagaagaagctggcccctgaacgagggcgtgatggccgtgggcctggtgagcatcctggccagcagcctgctgagaaacgacgtgcccatggccggccccctggtggccggcggcctgctgatcgcctgctacgtgatcaccggcaccagcgccgacctgaccgtggagaaggccgccgacgtgacctgggaggaggaggccgagcagaccggcgtgagccacaacctgatgatcaccgtggacgacgacggcaccatgagaatcaaggacgacgagaccgagaacatcctgaccgtgctgctgaagaccgccctgctgatcgtgagcggcatcttcccctacagcatccccgccaccctgctggtgtggcacacctggcagaagcagacccagagaagcggcgtgctgtgggacgtgcccagcccccccgagacccagaaggccgagctggaggagggcgtgtacagaatcaagcagcagggcatcttcggcaagacccaggtgggcgtgggcgtgcagaaggagggcgtgttccacaccatgtggcacgtgaccagaggcgccgtgctgacccacaacggcaagagactggagcccaactgggccagcgtgaagaaggacctgatcagctacggcggcggctggagactgagcgcccagtggcagaagggcgaggaggtgcaggtgatcgccgtggagcccggcaagaaccccaagaacttccagaccatgcccggcatcttccagaccaccaccggcgagatcggcgccatcgccctggacttcaagcccggcaccagcggcagccccatcatcaacagagagggcaaggtggtgggcctgtacggcaacggcgtggtgaccaagaacggcggctacgtgagcggcatcgcccagaccaacgccgagcccgacggccccacccccgagctggaggaggagatgttcaagaagagaaacctgaccatcatggacctgcaccccggcagcggcaagaccagaaagtacctgcccgccatcgtgagagaggccatcaagagaagactgagaaccctgatcctggcccccaccagagtggtggccgccgagatggaggaggccctgaagggcctgcccatcagataccagaccaccgccaccaagagcgagcacaccggcagagagatcgtggacctgatgtgccacgccaccttcaccatgagactgctgagccccgtgagagtgcccaactacaacctgatcatcatggacgaggcccacttcaccgaccccgccagcatcgccgccagaggctacatcagcaccagagtgggcatgggcgaggccgccgccatcttcatgaccgccaccccccccggcaccgccgaggccttcccccagagcaacgcccccatccaggacgaggagagagacatccccgagagaagctggaacagcggcaacgagtggatcaccgacttcgtgggcaagaccgtgtggttcgtgcccagcatcaaggccggcaacgacatcgccaactgcctgagaaagaacggcaagaaggtgatccagctgagcagaaagaccttcgacaccgagtaccagaagaccagactgaacgactgggacttcctggtgaccaccgacatcagcgagatgggcgccaacttcaaggccgacagagtgatcgaccccagaagatgcctgaagcccgtgatcctgaccgacggccccgagagagtgatcctggccggccccatgcccgtgaccgccgccagcgccgcccagagaagaggcagagtgggcagaaacccccagaaggagaacgaccagtacatcttcaccggccagcccctgaacaacgacgaggaccacgcccactggaccgaggccaagatgctgctggacaacatcaacacccccgagggcatcatccccgccctgttcgagcccgagagagagaagagcgccgccatcgacggcgagtacagactgaagggcgagagcagaaagaccttcgtggagctgatgagaagaggcgacctgcccgtgtggctggcccacaaggtggccagcgagggcatcaagtacaccgacagaaagtggtgcttcgacggcgagagaaacaaccagatcctggaggagaacatggacgtggagatctggaccaaggagggcgagagaaagaagctgagacccagatggctggacgccagaacctacagcgaccccctggccctgaaggagttcaaggacttcgccgccggcagaaagagcatcgccctggacctggtgaccgagatcggcagagtgcccagccacctggcccacagaaccagaaacgccctggacaacctggtgatgctgcacaccagcgagcacggcggcagagcctacagacacgccgtggaggagctgcccgagaccatggagaccctgctgctgctgggcctgatgatcctgctgaccggcggcgccatgctgttcctgatcagcggcaagggcatcggcaagaccagcatcggcctgatctgcgtgatcgtgagcagcggcatgctgtggatggccgacgtgcccctgcagtggatcgccagcgccatcgtgctggagttcttcatgatggtgctgctgatccccgagcccgagaagcagagaaccccccaggacaaccagctggcctacgtggtgatcggcatcctgaccctggccgccatcgtggccgccaacgagatgggcctgctggagaccaccaagagagacctgggcatgagcaaggagcccggcgtggtgagccccaccagctacctggacgtggacctgcaccccgccagcgcctggaccctgtacgccgtggccaccaccgtgatcacccccatgctgagacacaccatcgagaacagcaccgccaacgtgagcctggccgccatcgccaaccaggccgtggtgctgatgggcctggacaagggctggcccatcagcaagatggacctgggcgtgcccctgctggccctgggctgctacagccaggtgaaccccctgaccctgaccgccgccgtgctgctgctggtgacccactacgccatcatcggccccggcctgcaggccaaggccaccagagaggcccagaagagaaccgccgccggcatcatgaagaaccccaccgtggacggcatcatgaccatcgacctggaccccgtgatctacgacagcaagttcgagaagcagctgggccaggtgatgctgctggtgctgtgcgccgtgcagctgctgctgatgagaaccagctgggccctgtgcgaggccctgaccctggccaccggccccatcaccaccctgtgggagggcagccccggcaagttctggaacaccaccatcgccgtgagcatggccaacatcttcagaggcagctacctggccggcaccggcctggccttcagcatcatgaagagcgtgggcaccggcagaagaggcaccggcagccagggcgagaccctgggcgagaagtggaagaagaagctgaaccagctgagcagaaaggagttcgacctgtacaagaagagcggcatcaccgaggtggacagaaccgaggccaaggagggcctgaagagaggcgagaccacccaccacgccgtgagcagaggcagcgccaagctgcagtggttcgtggagagaaacatggtgatccccgagggcagagtgatcgacctgggctgcggcagaggcggctggagctactactgcgccggcctgaagaaggtgaccgaggtgagaggctacaccaagggcggccccggccacgaggagcccgtgcccatgagcacctacggctggaacatcgtgaagctgatgagcggcaaggacgtgttctacctgccccccgagaagtgcgacaccctgctgtgcgacatcggcgagagcagccccagccccaccgtggaggagagcagaaccatcagagtgctgaagatggtggagccctggctgaagaacaaccagttctgcatcaaggtgctgaacccctacatgcccaccgtgatcgagcacctggagagactgcagagaaagtacggcggcatgctggtgagaaaccccctgagcagaaacagcacccacgagatgtactggatcagcaacggcaccggcaacatcgtgagcagcgtgaacatggtgagcagactgctgctgaacagattcaccatgacccacagaagacccaccatcgagaaggacgtggacctgggcgccggcaccagacacgtgaacgccgagcccgagacccccaacatggacgtgatcggcgagagaatcaagagaatcaaggaggagcacagcagcacctggcactacgacgacgagaacccctacaagacctgggcctaccacggcagctacgaggtgaaggccaccggcagcgccagcagcatgatcaacggcgtggtgaagctgctgaccaagccctgggacgtggtgcccatggtgacccagatggccatgaccgacaccacccccttcggccagcagagagtgttcaaggagaaggtggacaccagaacccccagacccatgcccggcaccagaaaggtgatggagatcaccgccgagtggctgtggagaaccctgggcagaaacaagaagcccagactgtgcaccagagaggagttcaccaagaaggtgagaaccaacgccgccatgggcgccgtgttcaccgaggagaaccagtgggacagcgccagagccgccgtggaggacgaggagttctggaagctggtggacagagagagagagctgcacaagctgggcaagtgcggcagctgcgtgtacaacatgatgggcaagagagagaagaagctgggcgagttcggcaaggccaagggcagcagagccatctggtacatgtggctgggcgccagatacctggagttcgaggccctgggcttcctgaacgaggaccactggttcagcagagagaacagctacagcggcgtggagggcgagggcctgcacaagctgggctacatcctgagagacatcagcaagatccccggcggcgccatgtacgccgacgacaccgccggctgggacaccagaatcaccgaggacgacctgcacaacgaggagaagatcacccagcagatggaccccgagcacagacagctggccaacgccatcttcaagctgacctaccagaacaaggtggtgaaggtgcagagacccacccccaagggcaccgtgatggacatcatcagcagaaaggaccagagaggcagcggccaggtgggcacctacggcctgaacaccttcaccaacatggaggcccagctggtgagacagatggagggcgagggcgtgctgagcaaggccgacctggagaacccccacctgctggagaagaagatcacccagtggctggagaccaagggcgtggagagactgaagagaatggccatcagcggcgacgactgcgtggtgaagcccatcgacgacagattcgccaacgccctgctggccctgaacgacatgggcaaggtgagaaaggacatcccccagtggcagcccagcaagggctggcacgactggcagcaggtgcccttctgcagccaccacttccacgagctgatcatgaaggacggcagaaagctggtggtgccctgcagaccccaggacgagctgatcggcagagccagaatcagccagggcgccggctggagcctgaaggagaccgcctgcctgggcaaggcctacgcccagatgtggagcctgatgtacttccacagaagagacctgagactggccagcaacgccatctgcagcgccgtgcccgtgcactgggtgcccaccagcagaaccacctggagcatccacgcccaccaccagtggatgaccaccgaggacatgctgaccgtgtggaacagagtgtggatcgaggacaacccctggatggaggacaagacccccgtgaccacctgggaggacgtgccctacctgggcaagagagaggaccagtggtgcggcagcctgatcggcctgaccagcagagccacctgggcccagaacatcctgaccgccatccagcaggtgagaagcctgatcggcgacgaggagttcctggactacatgcccagcatgaagagattcagaaaggaggaggagagcgagggcgccatctggtga

SEQ ID NO: 18319 - RNA, 9867 nt, synthetic construct
  misc_feature 1..9867: note = derived and/or modified CDS sequence (opt4) from DENV-4__KR922405__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcctgggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaccaagacctggctggtgcacaagcagtggttcctggacctgcccctgccctggaccaccggcgccgacaccctggaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggagggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgccggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctggccctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacaccgagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccatgtacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggtgaaggccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagttcgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccgtgcccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaagacacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagagtgatcatgaccaccaccgccaactggctgtggaccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgccatgagaagatacagcgcccacttcgagagcgagggcgtgctgtga

SEQ ID NO: 18320 - RNA, 9867 nt, synthetic construct
  misc_feature 1..9867: note = derived and/or modified CDS sequence (opt4) from DENV-4__KP188557__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccagaatcttcacccccgaggccagaaacaacaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgagatgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacgcccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18321 - RNA, 9867 nt, synthetic construct
  misc_feature 1..9867: note = derived and/or modified CDS sequence (opt4) from DENV-4__KP188558__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacgacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatcagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18322 - RNA, 9867 nt, synthetic construct
  misc_feature 1..9867: note = derived and/or modified CDS sequence (opt4) from DENV-4__KP188563__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatcgccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacagagaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagatcgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgagcgtgatgaagagatacagcgcccccagcgagagcgagggcgtgctgtga

SEQ ID NO: 18323 - RNA, 9867 nt, synthetic construct
  misc_feature 1..9867: note = derived and/or modified CDS sequence (opt4) from DENV-4__KP188564__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatcgcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaagatcaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccaccctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccaacgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18324 - RNA, 9867 nt, synthetic construct
  misc_feature 1..9867: note = derived and/or modified CDS sequence (opt4) from DENV-4__JN983813__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacatcagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccgccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18325 - RNA, 9867 nt, synthetic construct
  misc_feature 1..9867: note = derived and/or modified CDS sequence (opt4) from DENV-4__KF041260__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctgatccagatcgagaacctggagtacaccgtggtggtgaccgtgcacaacggcgacacccacgccgtgggcaacgacaccagcaaccacggcgtgaccgccaccgtgacccccagaagccccagcgtggaggtggagctgcccgactacggcgagctgaccctggactgcgagcccagaagcggcatcgacttcaacgagatgatcctgatgaagatgaacaagaagacctggctggtgcacaagcagtggttcctggacctgcccctgccctggaccgccggcgccgacaccagcgaggtgcactggaaccacaaggagagaatggtgaccttcaaggtgccccacgccaagagacaggacgtgaccgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgagctgcatcgccgtgggcggcatcaccctgttcctgggcttcaccgtgcacgccgacatgggctgcgccgtgagctggagcggcaaggagctgaagtgcggcagcggcatcttcatcatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctgatcgacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccatgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcaacaccatgagcagcagaatgggcggccagacccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctgagcctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaccgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagagcggcagactggagcccagctgggccgacgtgaagaacgacatgatcagctacggcggcggctggagactgggcgacaagtgggacaaggaggaggacgtgcaggtgctggccgtggagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagaccgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtggtgcagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcatcaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatccacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccgtggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatgggcaagctgagcatgggcctgatcgccatcgccgtggccagcggcctgctgtgggtggccgagatccagccccagtggatcgccgccagcatcatcctggagttcttcctgatggccctgctgatccccgagcccgagaagcagagaaccccccaggacaaccagctgatctacgtgatcctgaccatcctgaccatcatcggcctggtggccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacacccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagatacagaaagcccacctacgagaaggacgccgacctgggcgccggcaccagaagcgtgagcaccgagaccgagaagcccgacatggccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccttcgagagcgagggcgtgctgtga

SEQ ID NO: 18326 - RNA, 9867 nt, synthetic construct
  misc_feature 1..9867: note = derived and/or modified CDS sequence (opt4) from DENV-4__FJ024476__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccgccacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccatgatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcctgctggtgctgtggatcggcaccaacagcagaaacaccagcatggccatgacctgcatcgccgtgggcggcatcaccctgttcctgggcttcaccgtgcaggccgacatgggctgcgtggtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccagaatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccatgggcccctggcacctgggcaagctggagatcggcttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagagagaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggtggtggtgatcaccctgtgcgccatcatcctgggcggcctgacctggatggacctgctgagagccctgatcatgctgggcgacaccatgagcggcagaatcggcggccagatccacctggccatcatggccgtgttcaagatgagccccggctacgtgctgggcgtgttcctgagaaagctgaccagcagagagaccgccctgatggtgatcggcatggccatgaccaccgtgctgagcatcccccacgacctgatggagctgatcgacggcatcagcctgggcctgatcctgctgaagatcgtgacccagttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtggtgcagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgagagagagagtggagaagtggctgaaggagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18327 - RNA, 9867 nt, synthetic construct
  misc_feature 1..9867: note = derived and/or modified CDS sequence (opt4) from DENV-4__GQ868579__SS-prME
  source 1..9867: mol_type = other RNA
agcaccatcaccctgctgtgcctgatccccaccatcatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctgatcaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgagagccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagagcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacagagaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcaccttcctgttcttcatgcagggcaagggcatcggcaagctgagcatgggcctgatcaccatcgccatggccagcggcctgctgtggatcgccgagatccagccccagtggatcgccgccagcatcatcctggagttcttcctgatggtgctgctgatccccgagcccgagaagcagagaaccccccaggacaaccagctgatctacgtgatcctgaccatcctggccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccaggcccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaactggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18328 - RNA, 9867 nt, synthetic construct
  misc_feature 1..9867: note = derived and/or modified CDS sequence (opt4) from DENV-4__GQ868580__SS-prME
  source 1..9867: mol_type = other RNA
agcaccatcaccctgctgtgcctgatccccaccatcatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctgatcaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgagcgacctgaagtacagctggaagacctggggcaaggccaagatcttcacccccgaggccagaaacagcaccttcctgatcgacggccccgacaccagcgagtgccccaacgagagaagagcctggaacagcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgaccgccggccagagcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccttcagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgctgggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacagagaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccagatggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccatggccagcggcctgctgtggatcgccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagagccccagactgtgcaccagagaggagttcatcagcaaggtgagaagcaacgccgccatcggcgccgtgttccaggaggagcagggctggaccagcgccagcgaggccgtgagcgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacagcctgaacaccttcaccaacatggaggtgcagctgatcagacagatggaggccgagggcgtgatcacccaggacgacatgcagaaccccaagggcctgaaggagagagtggagaactggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18329 - RNA, 9867 nt, synthetic construct
  misc_feature 1..9867: note = derived and/or modified CDS sequence (opt4) from DENV-4__GQ868583__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcatgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctggccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgcaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgagcgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18330 - RNA, 9867 nt, synthetic construct
  misc_feature 1..9867: note = derived and/or modified CDS sequence (opt4) from DENV-4__GQ868584__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggacagacagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcatgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctggccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgagcgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18331 - RNA, 9867 nt, synthetic construct
  misc_feature 1..9867: note = derived and/or modified CDS sequence (opt4) from DENV-4__GQ868585__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgaccaagaccaccgccaaggaggtggccctgctgagaacctactgcatcgaggccctgatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccaccggcgccgacaccagcgaggtgcactggaactacaaggagagaatggtgaccttcaaggtgccccacgccaagagacaggacgtgaccgtgctgggcagccaggagggcgccatgcacagcgccctggccggcgccaccgaggtggacagcggcgacgagaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcgccacccccctggccgagaacaccaacagcgtgaccaacatcgagctggagccccccttcggcgacagctacatcgtgatcggcgtgggcaacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatgatcagaatcctgatcggcttcctggtgctgtggatcggcaccaacagcagaaacaccagcatggccatgacctgcatcgccgtgggcggcatcaccctgttcctgggcttcaccgtgcaggccgacatgggctgcgtggtgagctggagcggcagagagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgccagcgacctgaagtacagctggaagacctggggcaaggccaagatcttcacccccgaggccagaaacagcaccttcctgatcgacggccccgacaccagcgagtgccccaacgagagaagagcctggaacagcttcgaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagagagccagcctgatcgaggtgaagacctgcctgtggcccaagacccacaccctgtggagcaacggcgtgctggagagccagatgctgatccccaagagctacgccggccccttcagccagcacaactacagacagggctacgccacccagaccgtgggcccctggcacctgggcaagctggagatcgacttcggcgagtgccccggcaccaccgtgaccatccaggagaactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgaccgccggccagggcaccagcgagaccttcagcatgggcctgctgtgcctgaccctgttcgtggaggagtgcctgagaagaagagtgaccagaaagcacatgatcctggccgtggtgatcaccctgtgcgccatcatcctgggcggcctgacctggatggacctgctgagagccctgatcatgctgggcgacaccatgagcggcagaatcggcggccagacccacctggccatcatggccgtgttcaagatgagccccggctacgtgctgggcgtgttcctgagaaagctgaccagcagagagaccgccctgatggtgatcggcatggccatgaccaccaccctgagcatcccccacgacctgatggagctgatcgacggcatcagcctgggcctgatcctgctgaagatcgtgacccagttcgacaacacccaggtgggcaccctggccctgagcctgaccttcatcagaagcaccatgagcctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcagaagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccatcaccatgaccctgtggtacatgtggcaggtgaagacccagagaagcggcgccctgtgggacgtgcccagccccgccgccacccagaaggccgccctgagcgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcaccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtgatcgacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcaacctggtgagatgccccctgagcagaaacagcacccacgagatgtactgggtgagcggcgccagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggagatcgacaagaaggacggcgacctgatgtacgccgacgacaccgccggctgggacaccagaatcaccgaggacgacctgcagaacgaggagctgatcaccgagcagatggccccccaccacaagatcctggccaaggccatcttcaagctgacctaccagaacaaggtggtgaaggtgctgagacccacccccagaggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgagagagtgcggcgtggacagactgaagagaatggccatcagcggcgacgactgcgtggtgaagcccctggacgagagattcggcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccagcgagagcgagggcgtgctgtga

SEQ ID NO: 18332 - RNA, 9867 nt, synthetic construct
  misc_feature 1..9867: note = derived and/or modified CDS sequence (opt4) from DENV-4__JQ922560__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagaagactgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcaccggcaagatcaccggcaacctgatccagatcgagaacctggagtacaccgtggtggtgaccgtgcacaacggcgacacccacgccgtgggcaacgacaccagcaaccacggcgtgaccgccaccatcacccccagaagccccagcgtggaggtggagctgcccgactacggcgagctgaccctggactgcgagcccagaagcggcatcgacttcaacgagatgatcctgatgaagatgaacaagaagacctggctggtgcacaagcagtggttcctggacctgcccctgccctgggccgccggcgccgacaccagcgaggtgcactggaaccacaaggagagaatggtgaccttcaaggtgccccacgccaagagacaggacgtgaccgtgctgggcagccaggagggcgccatgcacagcgccctgaccggcgccaccgaggtgtacagcggcgacggcaacctgatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagagtgatcagcagcacccccttcgccgagaacaccaacagcgtgaccaacatcgagctggagccccccttcggcgacagctacatcgtgatcggcgtgggcgacagcgccctgaccctgcactggttcaccaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgagctgcatcgccgtgggcggcatcaccctgttcctgggcttcaccgtgcacgccgacatgggctgcgccgtgagctggagcggcaaggagctgaagtgcggcagcggcatcttcatcatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctgatcgacggccccgacaccagcgagtgccccaacgagagaagagcctggaacttcctggaggtggaggactacggcttcggcatgttcaccaccaacatctggatgaagttcagagagggcagcagcgagatgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcaacaccatgagcagcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcgtggacggcatcagcctgggcctgatcctgctgaagatggtgacccacttcgacaacacccaggtgggcaccctggccctgagcctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaccgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccgtggagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtggtgcagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcatcaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccgtggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctgatcgccctgctgggcgccatgaccgccggcatcttcctgttcttcatgcagggcaagggcatgggcaagctgagcatgggcctgatcgccatcgccgtggccagcggcctgctgtgggtggccgagatccagccccagtggatcgccgccagcatcatcctggagttcttcctgatggccctgctgatccccgagcccgagaagcagagaaccccccaggacaaccagctgatctacgtgatcctgaccatcctgaccatcatcggcctggtggccgccaacgagatgggcctgatcgagaagaccaagaccgacttcggcttctaccaggagaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacacccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcagaaacatcgtgagcagcgtgaacaccaccagcaagatgctgctgaacagattcaccaccagatacagaaagcccacctacgagaaggacgccgacctgggcgccggcaccagaagcgtgagcaccgagaccgagaagcccgacatggccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagaatgatcatgaccaccaccgccaactggctgtgggccctgctgggcaagaagaagaaccccagactgtgcaccagagaggagttcatcagcaaggtgagaagcaacgccgccatcggcgccgtgagccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcatcgaggagtacgtggactacatgcccgtgatgaagagatacagcgcccccttcgagagcgagggcgtgctgtga

SEQ ID NO: 18333 - RNA, 9867 nt, synthetic construct
  misc_feature 1..9867: note = derived and/or modified CDS sequence (opt4) from DENV-4__JQ922558__SS-prME
  source 1..9867: mol_type = other RNA
agcaccctgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcacctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcctgggcaagatcaccggcaacctggtgcagatcgagaacctggagtacaccgtggtggtgaccgtgcacaacggcgacacccacgccgtgggcaacgacatcagcaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtgggtgctggacctgcccctgccctgggccgccggcgccgacaccagcaaggtgcagtggaactacaaggagagaatggtgaccttcaaggtgccccacgccaagagacaggacgtgaccgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagcacaccaacagcgtgaccaacatcgagctggagccccccttcggcgacagctacatcgtgatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgttcaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgacctgcatcgccatcggcggcatcaccctgttcctgggcttcaccgtgcacgccgacatgggctgcgccgtgagctggagcggcaaggagctgaagtgcggcagcggcatcttcgtggtggacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgaccaagggcaagagagccctgaccccccccgtgaacgacctgaagtacagctggaagacctggggcaaggccaagatcttcacccccgaggccagaaacagcaccttcctgatcgacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagccctggcagatcggcaacgccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccatcggcccctggcacctgggcaagctggagatcgacttcggcgagtgccccggcaccaccgtgaccatccaggaggactgcaaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctgaccatcatggccgtgttcaagatgagccccggctacgtgctgggcgtgttcctgagaaagctgaccagcagagagaccgccctgatcgtgatcggcatggccatgaccaccgtgctgagcatcccccacgacctgatggagttcatcgacggcatcagcctgggcctgatcctgctgaagatggtggcccacttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcactgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacaagaagggcaaggtgatcggcctgtacggcaacggcgtggtgaccaagagcggcgactacgtgagcgccatcacccaggccgagagaatcggcgaccccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccgccaaccccctgagcagcaccagagtgcccaactacaacctgatcgtgatggacgaggcccacctgcaggacctgagcatcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccagaagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagatccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcagagcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatggccatcgccgtggccagcggcctgctgtgggtggccgagatccagccccagtggatcgccgccagcatcatcctggagttcttcagcatggccctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgagcgtgcactacgccatcatcggccccggcctgcaggccaaggccaccagagaggcccagaagagaagcgccgccggcatcatgaagaaccccaccgtggacggcatcaccgtgatcgacctggagcccatcagctacgaccccaagttcgagaagcagctgggccaggtgatgctgctggccctgtgcgccggccagctgctgctgatgagaaccacctgggccttctgcgaggtgctgaccctggccaccggccccatcctgaccctgtgggagggcaaccccggcagattctggaacaccaccatccccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcttcgaggtggacagacacgagatcaagtacaccctgaaggacggcagcaagatcaaccacgccatgagcaccggcagcatcaagatcagaggcatcgacgagagaggcatggtgaagcccaagggcaaggtggtggaccagggctgcggcagaggcggctggagccactacaccgccaccgccaagaaggtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgtggacctgggcgccggcaccagaagcgtgagcatcgagaccgagaagcccgacatgaccatcatcggcagaagactgcagagactgagagaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagagttcaaggagaaggtgtacaccagcaccccccaccccaagccctggaccagaatggtgatgaccaccaccgccaactggctgtgggccctgggcggcaagaagaagagccccagactgtgcacctgggaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacagaatcctggccaaggccatcttcaagctgacctaccacagcaaggtgatgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcagaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacgtgccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccatcgagagcgagggcgtgctgtga

SEQ ID NO: 18334 - RNA, 9867 nt, synthetic construct
  misc_feature 1..9867: note = derived and/or modified CDS sequence (opt4) from DENV-4__JQ922559__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcctgtgcagcggcaagatcaccggcaacctggtgcagatcgagaacctggagtacaccgtggtggtgaccgtgcacaacggcgacacccacgccgtgggcaacgacatcagcatccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctggaccgccggcgccgacaccagcgaggtgcagtggaactacaaggagagaatggtgaccttcaaggtgccccacgccaagagacaggacgtgaccgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagaacacctacagcgtgaccaacatcgagctggagccccccttcggcgacagctacatcatcatcggcgtgggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgccgtgggcggcatcaccctgttcctgggcttcaccgtgcacgccgacatgggctgcgccgtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccatcgtggccggcgacgtgaagggcgtgctgagcaagggcaagagagccctggccccccccgtgaacgacctgaagtacagctggaagacctggggcaaggccaagatcttcacccccgagaccagaaacagcaccttcctgatcgacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagagagaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcagcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccagatgggcaccctggccctgagcctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgctgagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgtgatgggcgccaacttcagagccggcagagtgatcgaccccagaagatgcctgaagcccgtgatcatcaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcgagctgagcatgggcctgatcgccatcgccggcgccagcggcctgctgtggggcaccaagaccccccccccctggggcgccgccagcaacatcctggagttcttcctgatggtgctgctgatccccgagcccgagaagcagagaaccccccaggacaaccagctgatctacgtgatcctgaccatcctgaccatcatcggcctggtggccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgatcgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcgtgaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcaggccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcagagtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccaagcacagaaagcccacctacgagaaggacgccgacctgggcgccggcaccagaagcgtgagcaccgagaccgagaagcccgacatgaccatcatcggcagaagactgcagagactgcaggaggagcaccaggagacctggcactacgaccaggagaacccctacagaacctgggcctaccacggcggctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgagccaggaggagcagggctggaccagcagcttcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacctggacaagagagacagaagcctggtgttcgccgacgacaccgccggctgggacaccaagatccccgaggacgacctgctgaaggagaagcccatccccggccccatggccccccaccagagaatccccgccagagccatcttcaagctgacctaccagaacaaggtggtgaaggtgctgagactgaagctgaagggcgccgtgatggacatcatcagcagaaaggagcagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactggagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcatcgagggctacgtggactacttcctgctgatcaagtggtacagcgcccccttcgagagcgagggcgtgctgtga

SEQ ID NO: 18335 - RNA, 9867 nt, synthetic construct
  misc_feature 1..9867: note = derived and/or modified CDS sequence (opt4) from DENV-4__KF955510__SS-prME
  source 1..9867: mol_type = other RNA
agcaccatcaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacaagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagaaccgagacctggatgagcagcgagggcgcctggaagcacgcccagagagtggagagctggatcctgagaaagcccggcttcgccctgagcgccggcttcatggcctacatgatcggccagaccggcatccagagaaccgtgttcttcatcctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacatggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacaccagcaaccacggcgagaccgccaccatcacccccagaagccccagcgtggaggtgagactgcccgactacggcgagctgaccctggactgcgagcccagaagcggcatcgacttcaacgagatgatcctgatgaagatgaagaccaagacctggctggtgcacaagcagtggttcctggacctgcccctgccctggaccgccggcgccgacaccagcgaggtgcactggaaccacaaggagagaatggtgaccttcaaggtgccccacgccaagagacaggacgtgaccgtgctgggcagccaggagggcgccatgcacagcgccctggccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcaccggcgccccctgcaaggtgcccatcgagatcagagacgtgaacaaggagaaggtggtgggcagaatcatcagcagcacccccttcgccgagaacaccaacagcgtgaccaacatcgagctggagccccccttcggcgacagctacatcgtgatcggcgccggcgacagcgccctgaccctgcactggttcagaaagggcagcagcatcggcaagatgttcgagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcctgctggtgctgtggatcggcaccaacagcagaaacaccagcatggccatgagctgcatcgtggtgggcggcatcaccctgttcctgggcttcaccgtgcacgccgacatgggctgcgtggtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacgtgatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgagaccagaaacagcaccttcctggtggacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccatcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgaacgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccatgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctgagcctgaccttcatcaagagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacgtggaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgcctacagaatcatgcagagaggcctgttcggcaagacccaggtgggcgtgggcatccacatggagggcgtgttccacaccatgtggcacgtgaccagaggcagcgtgatctgccacgagagcggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaatcggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcaccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcctgaccgacggccccgagagagtgatcctggccggccccatccccgtgacccccgccagcgccgcccagagaagaggcagaatcggcagaaaccccgcccaggaggacgaccagtacgtgttcagcggcgaccccctgagaaacgacgaggaccacgcccactggaccgaggccaagatgctgctggacaacatctacacccccgagggcatcatccccaccctgttcggccccgagagagagaagacccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatgggcaagctgagcatgggcctgatcgccatcgccgtggccagcggcctgctgtgggtggccgagatccagccccagtggatcgccgccagcatcatcctggagttcttcctgatggtgctgctggtgcccgagcccgagaagcagagaaccccccaggacaaccagctgatctacgtgatcctgaccatcctgaccatcatcgccctggtggccgccaacgagatgggcctgatcgagaagaccaagaccgacttcggcttctaccaggccaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgaccgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccatcctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaagggcttcgaggagtacaagagaagcggcatcctggaggtggacagaaccgaggccaagagcgccctgaaggacggcagcaagatcaagtacgccgtgagcagaggcaccagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgccgacctgggcgccggcaccagaagcgtgagcaccgagaccgagaagcccgacatgaccatcatcggcagaagactgcagagactgcaggaggagcacaaggagacctggcactacgaccacgagaacccctacagaacctgggcctaccacggcagctacgaggcccccagcaccggcagcgccagcagcatggtgaacggcgtggtgaagctgctgaccaagccctgggacgtggtgcccatggtgacccagctggccatgaccgacaccacccccttcggccagcagagagtgttcaaggagaaggtggacaccagaaccccccagcccaagcccggcaccagagtggtgatgaccaccaccgccaactggctgtgggccctgctgggcagaaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcaccagagacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgatcgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccacttcgagagcgagggcgtgctgtga

SEQ ID NO: 18336 - RNA, 9867 nt, synthetic construct
  misc_feature 1..9867: note = derived and/or modified CDS sequence (opt4) from DENV-4__GQ868594__SS-prME
  source 1..9867: mol_type = other RNA
agcaccatgaccctgctgtgcctgatccccaccgtgatggccttccacctgagcaccagagacggcgagcccctgatgatcgtggccaagcacgagagaggcagacccctgctgttcaagaccaccgagggcatcaacaagtgcaccctgatcgccatggacctgggcgagatgtgcgaggacaccgtgacctacgagtgccccctgctggtgaacaccgagcccgaggacatcgactgctggtgcaacctgaccagcgcctgggtgatgtacggcacctgcacccagagcggcgagagaagaagagagaagagaagcgtggccctgaccccccacagcggcatgggcctggagaccagagccgagacctggatgagcagcgagggcgcctggaagcacgcccagagagtggagagctggatcctgagaaaccccggcttcgccctgctggccggcttcatggcctacatgatcggccagaccggcatccagagaaccgtgttcttcgtgctgatgatgctggtggcccccagctacggcatgagatgcgtgggcgtgggcaacagagacttcgtggagggcgtgagcggcggcgcctgggtggacctggtgctggagcacggcggctgcgtgaccaccatggcccagggcaagcccaccctggacttcgagctgatcaagaccaccgccaaggaggtggccctgctgagaacctactgcatcgaggccagcatcagcaacatcaccaccgccaccagatgccccacccagggcgagccctacctgaaggaggagcaggaccagcagtacatctgcagaagagacgtggtggacagaggctggggcaacggctgcggcctgttcggcaagggcggcgtggtgacctgcgccaagttcagctgcagcggcaagatcaccggcaacctggtgcagatcgagaacctggagtacaccgtggtggtgaccgtgcacaacggcgacacccacgccgtgggcaacgacatccccaaccacggcgtgaccgccaccatcacccccagaagccccagcgtggaggtgaagctgcccgactacggcgagctgaccctggactgcgagcccagaagcggcatcgacttcaacgagatgatcctgatgaagatgaagaagaagacctggctggtgcacaagcagtggttcctggacctgcccctgccctgggccgccggcgccgacaccagcgaggtgcactggaactacaaggagagaatggtgaccttcaaggtgccccacgccaagagacaggacgtgatcgtgctgggcagccaggagggcgccatgcacagcgccctgaccggcgccaccgaggtggacagcggcgacggcaaccacatgttcgccggccacctgaagtgcaaggtgagaatggagaagctgagaatcaagggcatgagctacaccatgtgcagcggcaagttcagcatcgacaaggagatggccgagacccagcacggcaccaccgtggtgaaggtgaagtacgagggcgccggcgccccctgcaaggtgcccatcgagatcagagacgtgaacaaggagaaggtggtgggcagaatcatcagcagcacccccttcgccgagtacaccaacagcgtgaccaacatcgagctggagccccccttcggcgacagctacatcgtgatcggcgtgggcgacagcgccctgaccctgcactggttcagaaagggcagcagcatcggcaagatgctggagagcacctacagaggcgccaagagaatggccatcctgggcgagaccgcctgggacttcggcagcgtgggcggcctgctgaccagcctgggcaaggccgtgcaccaggtgttcggcagcgtgtacaccaccatgttcggcggcgtgagctggatggtgagaatcctgatcggcttcctggtgctgtggatcggcaccaacagcagaaacaccagcatggccatgacctgcatcgccgtgggcggcatcaccctgttcctgggcttcaccgtgcacgccgacaccggctgcgccgtgagctggagcggcaaggagctgaagtgcggcagcggcatcttcgtgatcgacaacgtgcacacctggaccgagcagtacaagttccagcccgagagccccgccagactggccagcgccatcctgaacgcccacaaggacggcgtgtgcggcatcagaagcaccaccagactggagaacatcatgtggaagcagatcaccaacgagctgaactacgtgctgtgggagggcggccacgacctgaccgtggtggccggcgacgtgaagggcgtgctgagcaagggcaagagagccctggccccccccgtgaacgacctgaagtacagctggaagacctggggcaaggccaagatcttcacccccgaggccaagaacagcaccttcctgatcgacggccccgacaccagcgagtgccccaacgagagaagagcctggaacttcctggaggtggaggactacggcttcggcatgttcaccaccaacatctggatgaagttcagagagggcagcagcgaggtgtgcgaccacagactgatgagcgccgccatcaaggaccagaaggccgtgcacgccgacatgggctactggatcgagagcagcaagaaccagacctggcagatcgagaaggccagcctgatcgaggtgaagacctgcctgtggcccaagacccacaccctgtggagcaacggcgtgctggagagccagatgctgatccccaaggcctacgccggccccttcagccagcacaactacagacagggctacgccacccagaccgtgggcccctggcacctgggcaagctggagatcgacttcggcgagtgccccggcaccaccgtgaccatccaggaggactgcgaccacagaggccccagcctgagaaccaccaccgccagcggcaagctggtgacccagtggtgctgcagaagctgcaccatgccccccctgagattcctgggcgaggacggctgctggtacggcatggagatcagacccctgagcgagaaggaggagaacatggtgaagagccaggtgagcgccggccagggcaccagcgagaccttcagcatgggcctgctgtgcctgaccctgttcgtggaggagtgcctgagaagaagagtgaccagaaagcacatgatcctggtggtggtgaccaccctgtgcgccatcatcctgggcggcctgacctggatggacctgctgagagccctgatcatgctgggcgacaccatgagcggcagaatgggcggccagatccacctggccatcatggccgtgttcaagatgagccccggctacgtgctgggcatcttcctgagaaagctgaccagcagagagaccgccctgatggtgatcggcatggccatgaccaccgtgctgagcatcccccacgacctgatggagttcatcgacggcatcagcctgggcctgatcctgctgaagatggtgacccacttcgacaacacccaggtgggcaccctggccctgagcctgaccttcatcagaagcaccatgcccctggtgatggcctggagaaccatcatggccgtgctgttcgtggtgaccctgatccccctgtgcagaaccagctgcctgcagaagcagagccactgggtggagatcaccgccctgatcctgggcgcccaggccctgcccgtgtacctgatgaccctgatgaagggcgccagcaagagaagctggcccctgaacgagggcatcatggccgtgggcctggtgagcctgctgggcagcgccctgctgaagaacgacgtgcccctggccggccccatggtggccggcggcctgctgctggccgcctacgtgatgagcggcagcagcgccgacctgagcctggagaaggccgccaacgtgcagtgggacgagatggccgacatcaccggcagcagccccatcatcgaggtgaagcaggacgaggacggcagcttcagcatcagagacatcgaggagaccaacatgatcaccctgctggtgaagctggccctgatcaccgtgagcggcctgtaccccctggccatccccgtgaccatgaccctgtggtacatgtggcaggtgaagacccagagaagcggcgccctgtgggacgtgcccagccccgccgccgcccagaaggccaccctgaccgagggcgtgtacagaatcatgcagagaggcctgttcggcaagacccaggtgggcgtgggcatccacatggagggcgtgttccacaccatgtggcacgtgaccagaggcagcgtgatctgccacgagaccggcagactggagcccagctgggccgacgtgagaaacgacatgatcagctacggcggcggctggagactgggcgacaagtgggacaaggaggaggacgtgcaggtgctggccatcgagcccggcaagaaccccaagcacgtgcagaccaagcccggcctgttcaagaccctgaccggcgagatcggcgccgtgaccctggacttcaagcccggcaccagcggcagccccatcatcaacagaaagggcaaggtgatcggcctgtacggcaacggcgtggtgaccaagagcggcgactacgtgagcgccatcacccaggccgagagaaccggcgagcccgactacgaggtggacgaggacatcttcagaaagaagagactgaccatcatggacctgcaccccggcgccggcaagaccaagagaatcctgcccagcatcgtgagagaggccctgaagagaagactgagaaccctgatcctggcccccaccagagtggtggccgccgagatggaggaggccctgagaggcctgcccatcagataccagacccccgccgtgaagagcgagcacaccggcagagagatcgtggacctgatgtgccacgccaccttcaccaccagactgctgagcagcaccagagtgcccaactacaacctgatcgtgatggacgaggcccacttcaccgaccccagcagcgtggccgccagaggctacatcagcaccagagtggagatgggcgaggccgccgccatcttcatgaccgccaccccccccggcgccaccgaccccttcccccagagcaacagccccatcgaggacatcgagagagagatccccgagagaagctggaacaccggcttcgactggatcaccgactaccagggcaagaccgtgtggttcgtgcccagcatcaaggccggcaacgacatcgccaactgcctgagaaagagcggcaagaaggtgatccagctgagcagaaagaccttcgacaccgagtaccccaagaccaagctgaccgactgggacttcgtggtgaccaccgacatcagcgagatgggcgccaacttcagagccggcagagtgatcgaccccagaagatgcctgaagcccgtgatcagcaccgacggccccgagagagtgatcctggccggccccatccccgtgacccccgccagcgccgcccagagaagaggcagaatcggcagaaaccccgcccaggaggacgaccagtacgtgttcagcggcgaccccctgaagaacgacgaggaccacgcccactggaccgaggccaagatgctgctggacaacatctacacccccgagggcatcatccccaccctgttcggccccgagagagagaagaaccaggccatcgacggcgagttcagactgagaggcgagcagagaaagaccttcgtggagctgatgagaagaggcgacctgcccgtgtggctgagctacaaggtggccagcgccggcatcagctacaaggacagagagtggtgcttcaccggcgagagaaacaaccagatcctggaggagaacatggaggtggagatctggaccagagagggcgagaagaagaagctgagacccaagtggctggacgccagagtgtacgccgaccccatggccctgaaggacttcaaggagttcgccagcggcagaaagagcatcaccctggacatcctgaccgagatcgccagcctgcccacctacctgagcagcagagccaagctggccctggacaacatcgtgatgctgcacaccaccgagagaggcggcaaggcctaccagcacgccctgaacgagctgcccgagagcctggagaccctgatgctggtggccctgctgggcgccatgaccgccggcatcttcctgttcttcatgcagggcaagggcatcggcaagctgagcatgggcctgatcgccatcgccgtggccagcggcctgctgtgggtggccgagatccagccccagtggatcgccgccagcatcatcctggagttcttcctgatggtgctgctgatccccgagcccgagaagcagagaaccccccaggacaaccagctgatctacgtgatcctgaccatcctgaccatcatcggcctgatcgccgccaacgagatgggcctgatcgagaagaccaagaccgacttcggcttctaccaggtgaagaccgagaccaccatcctggacgtggacctgagacccgccagcgcctggaccctgtacgccgtggccaccaccatcctgacccccatgctgagacacaccatcgagaacaccagcgccaacctgagcctggccgccatcgccaaccaggccgccgtgctgatgggcctgggcaagggctggcccctgcacagaatggacctgggcgtgcccctgctggccatgggctgctacagccaggtgaaccccaccaccctgatcgccagcctggtgatgctgctggtgcactacgccatcatcggccccggcctgcaggccaaggccaccagagaggcccagaagagaaccgccgccggcatcatgaagaaccccaccgtggacggcatcaccgtgatcgacctggagcccatcagctacgaccccaagttcgagaagcagctgggccaggtgatgctgctggtgctgtgcgccggccagctgctgctgatgagaaccacctgggccttctgcgaggtgctgaccctggccaccggccccgtgctgaccctgtgggagggcaaccccggcagattctggaacaccaccatcgccgtgagcaccgccaacatcttcagaggcagctacctggccggcgccggcctggccttcagcctgatcaagaacgcccagacccccagaagaggcaccggcaccaccggcgagaccctgggcgagaagtggaagagacagctgaacagcctggacagaaaggagttcgaggagtacaagagaagcggcatcctggaggtggacagaaccgaggccaagagcgccctgaaggacggcagcaagatcaagcacgccgtgagcagaggcagcagcaagatcagatggatcgtggagagaggcatggtgaagcccaagggcaaggtggtggacctgggctgcggcagaggcggctggagctactacatggccaccctgaagaacgtgaccgaggtgaagggctacaccaagggcggccccggccacgaggagcccatccccatggccacctacggctggaacctggtgaagctgcacagcggcgtggacgtgttctacaagcccaccgagcaggtggacaccctgctgtgcgacatcggcgagagcagcagcaaccccaccatcgaggagggcagaaccctgagagtgctgaagatggtggagccctggctgagcagcaagcccgagttctgcatcaaggtgctgaacccctacatgcccaccgtgatcgaggagctggagaagctgcagagaaagcacggcggcagcctggtgagatgccccctgagcagaaacagcacccacgagatgtactgggtgagcggcgtgagcggcaacatcgtgagcagcgtgaacaccaccagcaagatgctgctgaacagattcaccaccagacacagaaagcccacctacgagaaggacgtggacctgggcgccggcaccagaagcgtgagcaccgagaccgagaagcccgacatgaccatcatcggcagaagactgcagagactgcaggaggagcacaaggagacctggcactacgaccaggagaacccctacagaacctgggcctaccacggcagctacgaggcccccagcaccggcagcgccagcagcatggtgaacggcgtggtgaagctgctgaccaagccctgggacgtgatccccatggtgacccagctggccatgaccgacaccacccccttcggccagcagagagtgttcaaggagaaggtggacaccagaaccccccagcccaagcccggcaccagaatggtgatgaccaccaccgccaactggctgtgggccctgctgggcaagaagaagaaccccagactgtgcaccagagaggagttcatcagcaaggtgagaagcaacgccgccatcggcgccgtgttccaggaggagcagggctggaccagcgccagcgaggccgtgaacgacagcagattctgggagctggtggacaaggagagagccctgcaccaggagggcaagtgcgagagctgcgtgtacaacatgatgggcaagagagagaagaagctgggcgagttcggcagagccaagggcagcagagccatctggtacatgtggctgggcgccagattcctggagttcgaggccctgggcttcctgaacgaggaccactggttcggcagagagaacagctggagcggcgtggagggcgagggcctgcacagactgggctacatcctggaggacatcgacaagaaggacggcgacctgatctacgccgacgacaccgccggctgggacaccagaatcaccgaggacgacctgctgaacgaggagctgatcaccgagcagatggccccccaccacaagatcctggccaaggccatcttcaagctgacctaccagaacaaggtggtgaaggtgctgagacccacccccaagggcgccgtgatggacatcatcagcagaaaggaccagagaggcagcggccaggtgggcacctacggcctgaacaccttcaccaacatggaggtgcagctgatcagacagatggaggccgagggcgtgatcacccaggacgacatgcacaaccccaagggcctgaaggagagagtggagaagtggctgaaggagtgcggcgtggacagactgaagagaatggccatcagcggcgacgactgcgtggtgaagcccctggacgagagattcagcaccagcctgctgttcctgaacgacatgggcaaggtgagaaaggacatcccccagtgggagcccagcaagggctggaagaactggcaggaggtgcccttctgcagccaccacttccacaagatcttcatgaaggacggcagaagcctggtggtgccctgcagaaaccaggacgagctgatcggcagagccagaatcagccagggcgccggctggagcctgagagagaccgcctgcctgggcaaggcctacgcccagatgtggagcctgatgtacttccacagaagagacctgagactggccagcatggccatctgcagcgccgtgcccaccgagtggttccccaccagcagaaccacctggagcatccacgcccaccaccagtggatgaccaccgaggacatgctgaaggtgtggaacagagtgtggatcgaggacaaccccaacatgaccgacaagacccccgtgcacagctgggaggacatcccctacctgggcaagagagaggacctgtggtgcggcagcctgatcggcctgagcagcagagccacctgggccaagaacatccacaccgccatcacccaggtgagaaacctgatcggcaaggaggagtacgtggactacatgcccgtgatgaagagatacagcgcccccttcgagagcgagggcgtgctgtga
